United States Patent
Schneeberger et al.

(10) Patent No.: US 7,696,409 B2
(45) Date of Patent: Apr. 13, 2010

(54) NUCLEOTIDE SEQUENCES AND POLYPEPTIDES ENCODED THEREBY USEFUL FOR MODIFYING NITROGEN USE EFFICIENCY CHARACTERISTICS IN PLANTS

(75) Inventors: Richard Schneeberger, Van Nuys, CA (US); Emilio Margolles-Clark, Thousand Oaks, CA (US); Gerard Magpantay, Calabasas, CA (US)

(73) Assignee: Ceres, Inc., Thousand Oaks, CA (US)

( * ) Notice: Subject to any disclaimer, the term of this patent is extended or adjusted under 35 U.S.C. 154(b) by 645 days.

(21) Appl. No.: 11/114,963

(22) Filed: Apr. 25, 2005

(65) Prior Publication Data
US 2007/0044172 A1   Feb. 22, 2007

Related U.S. Application Data

(60) Provisional application No. 60/564,659, filed on Apr. 23, 2004.

(51) Int. Cl.
*C12N 15/82* (2006.01)
*C12N 15/87* (2006.01)

(52) U.S. Cl. ........................ 800/278; 800/290
(58) Field of Classification Search ............... None
See application file for complete search history.

(56) References Cited

U.S. PATENT DOCUMENTS

| | | | |
|---|---|---|---|
| 2003/0233670 A1 | 12/2003 | Edgerton et al. | |
| 2004/0009476 A9 * | 1/2004 | Harper et al. | 435/6 |
| 2004/0034888 A1 | 2/2004 | Liu et al. | |

FOREIGN PATENT DOCUMENTS

| | | |
|---|---|---|
| EP | 1033405 | 9/2000 |
| WO | WO-2005/103270 | 11/2005 |

OTHER PUBLICATIONS

Guo et al. 2004, Proc. Natl. Acad. Sci. USA 101: 9205-9210.*
Hill et al 1998, Biochem. Biophys. Res. Comm. 244:573-577.*
Falcon-Perez JM et al. 1999, J Biol Chem. 274:23584-90.*
Lazar et al. 1988, Mol. Cell. Biol. 8:1247-1252.*
Fourgoux-Nicol et al. 1999, Plant Molecular Biology 40 :857-872.*
Sweetlove et al. 1996, Biochem. J. 320:493-498.*
Fraisier, Vincent et al. "Constitutive expression of a putative high-affinity nitrate transporter in *Nicotiana plumbaginifolia*: Evidence for post-transcriptional regulation by a reduced nitrogen source," Plant Journal, vol. 23, No. 4, Aug. 2000, pp. 489-496.
Huang, Nien-Chen et al. "CHL1 encodes a component of the low-affinity nitrate uptake system in *Arabidopsis* and shows cell type-specific expression in roots," Plant Cell, vol. 8, No. 12, 1996, pp. 2183-2191.
Oliveira, Igor C. et al. "Overexpression of cytosolic glutamine synthetase. Relation to nitrogen, light, and photorespiration," Plant Physiology (Rockville), vol. 129, No. 3, Jul. 2002, pp. 1170-1180.

* cited by examiner

*Primary Examiner*—Ashwin Mehta
*Assistant Examiner*—Li Zheng
(74) *Attorney, Agent, or Firm*—Birch, Stewart Kolasch & Birch LLP

(57) ABSTRACT

Isolated polynucleotides and polypeptides encoded thereby are described, together with the use of those products for making transgenic plants with increased nitrogen use efficiency. The present invention further relates to nucleotide sequences and the use of those nucleotide sequences in the genetic-engineering of plants to display enhanced nitrogen assimilatory and utilization capacities, grow larger, more efficiently or rapidly, and/or have enriched nitrogen contents in vegetative and/or reproductive plant parts and/or increased biomass. More particularly, this invention relates to producing transgenic plants engineered to have altered expression of key components in the nitrogen assimilation and utilization pathways. The engineered plants may be productively cultivated under conditions of low nitrogen fertilizer input or in nitrogen poor soils. Alternatively, the engineered plants may be used to achieve faster growing or maturing crops, higher crop yields and/or more nutritious products under ideal cultivation conditions.

2 Claims, 5 Drawing Sheets

Figure 2C:
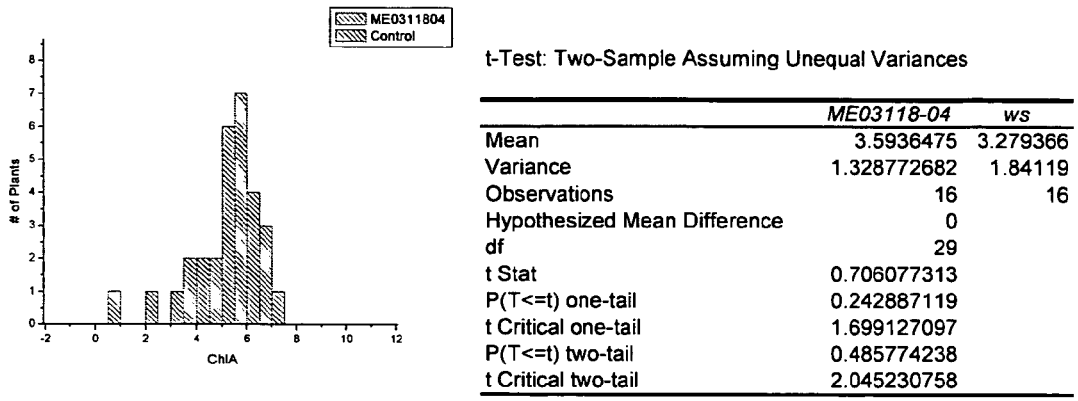
Figure 2D:
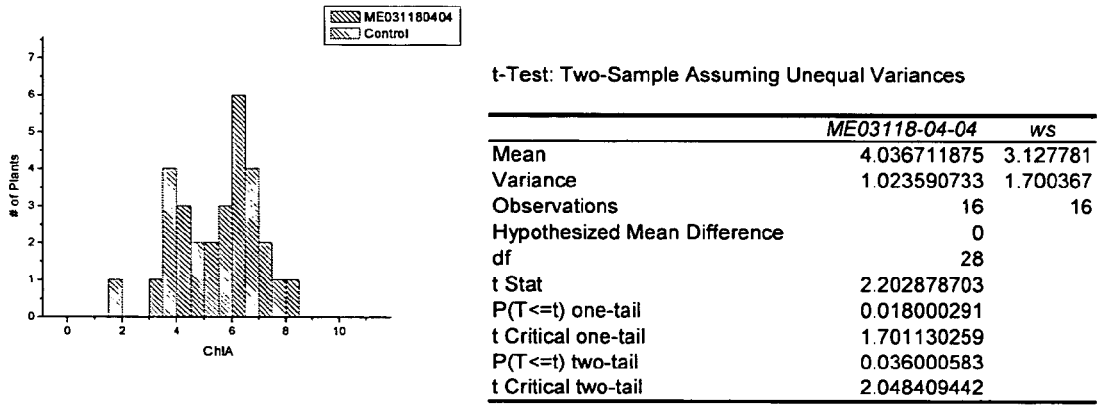
Figure 3C:
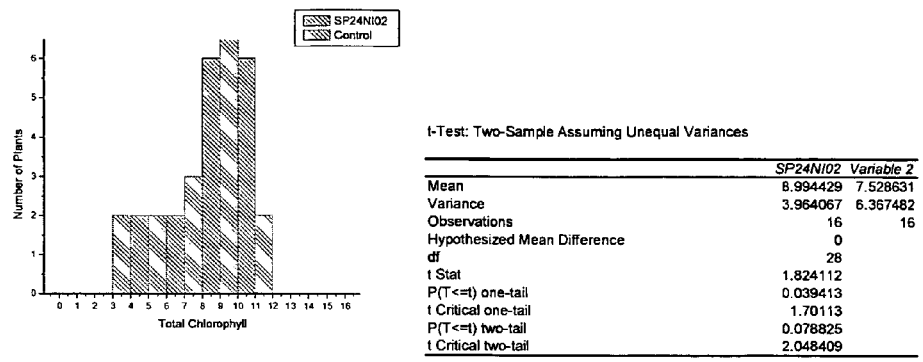
Figure 4A:
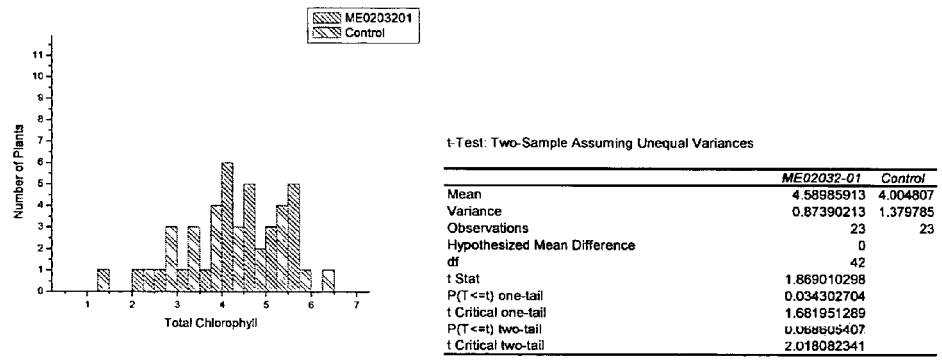
Figure 4B:
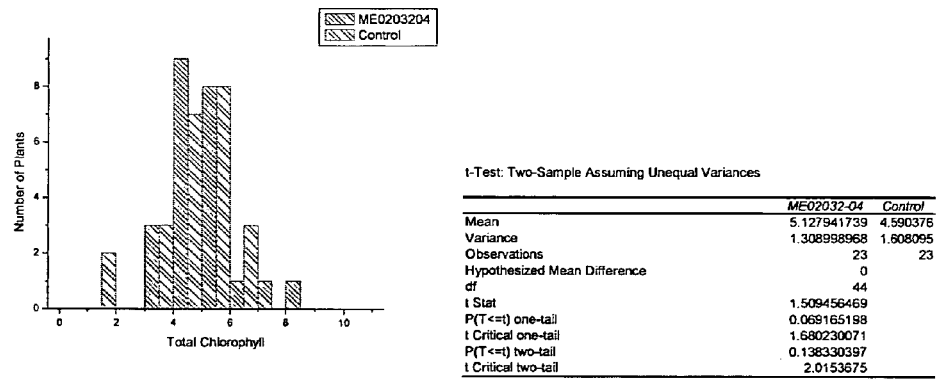
Figure 4C:
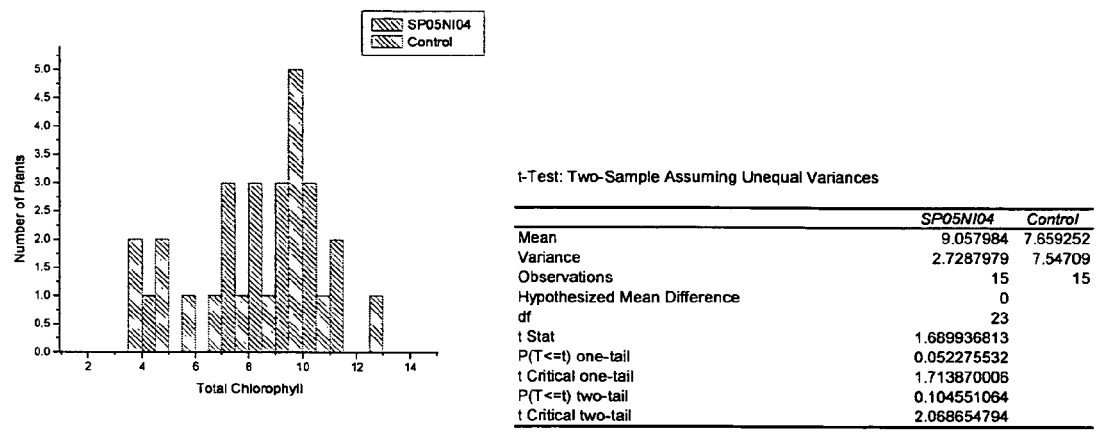
Figure 5:
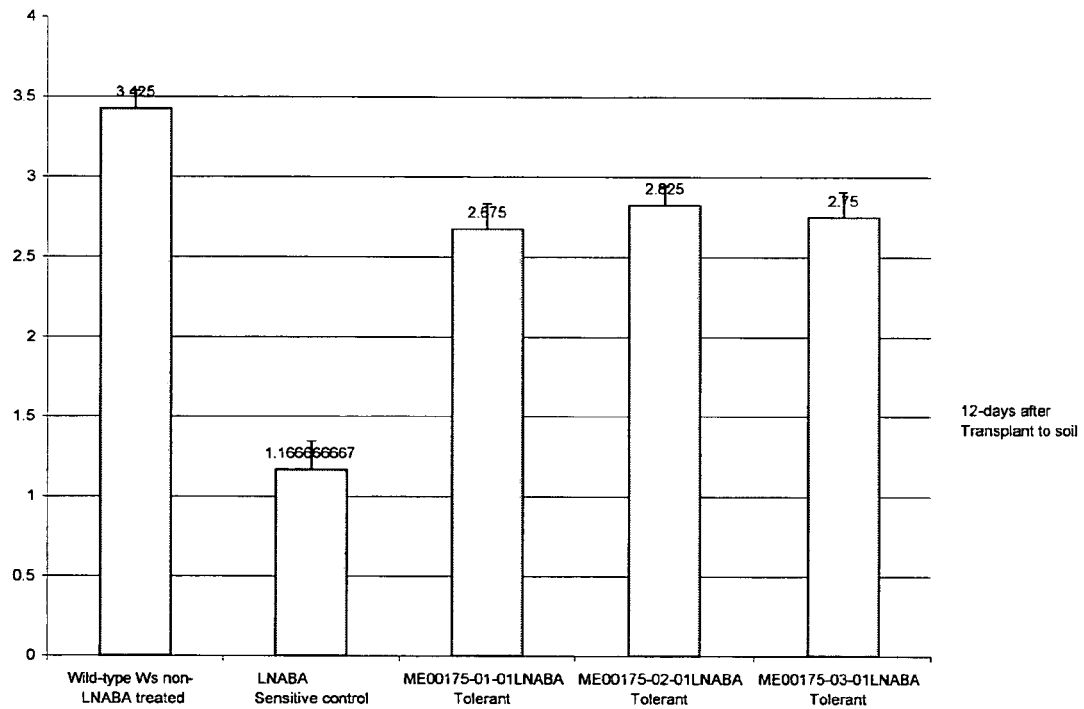

Figure 1. The action of methionine sulfoximine (MSX) in inhibiting N assimilation.

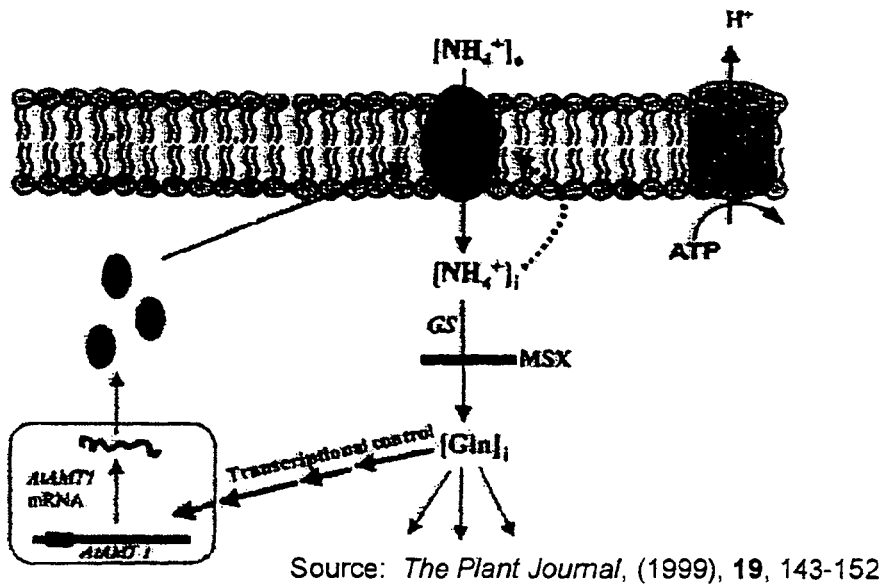

Source: *The Plant Journal*, (1999), 19, 143-152

FIGURE 2A

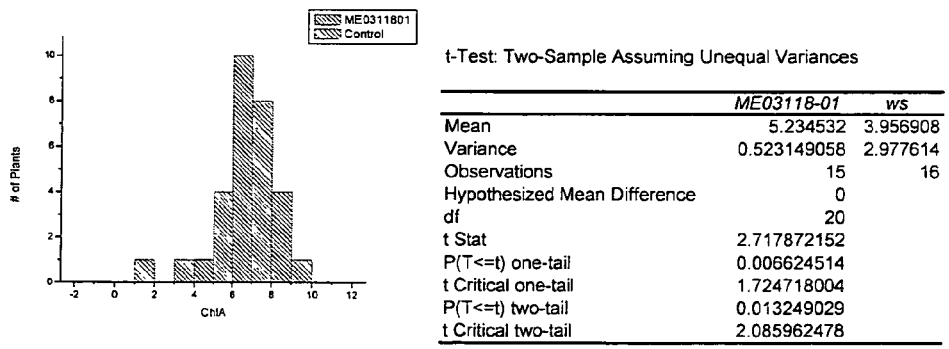

t-Test: Two-Sample Assuming Unequal Variances

|  | ME03118-01 | ws |
|---|---|---|
| Mean | 5.234532 | 3.956908 |
| Variance | 0.523149058 | 2.977614 |
| Observations | 15 | 16 |
| Hypothesized Mean Difference | 0 | |
| df | 20 | |
| t Stat | 2.717872152 | |
| P(T<=t) one-tail | 0.006624514 | |
| t Critical one-tail | 1.724718004 | |
| P(T<=t) two-tail | 0.013249029 | |
| t Critical two-tail | 2.085962478 | |

FIGURE 2B

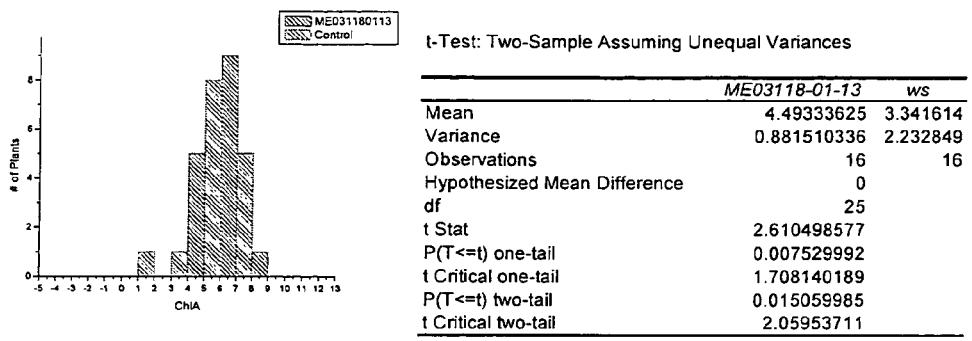

t-Test: Two-Sample Assuming Unequal Variances

|  | ME03118-01-13 | ws |
|---|---|---|
| Mean | 4.49333625 | 3.341614 |
| Variance | 0.881510336 | 2.232849 |
| Observations | 16 | 16 |
| Hypothesized Mean Difference | 0 | |
| df | 25 | |
| t Stat | 2.610498577 | |
| P(T<=t) one-tail | 0.007529992 | |
| t Critical one-tail | 1.708140189 | |
| P(T<=t) two-tail | 0.015059985 | |
| t Critical two-tail | 2.05953711 | |

FIGURE 3A

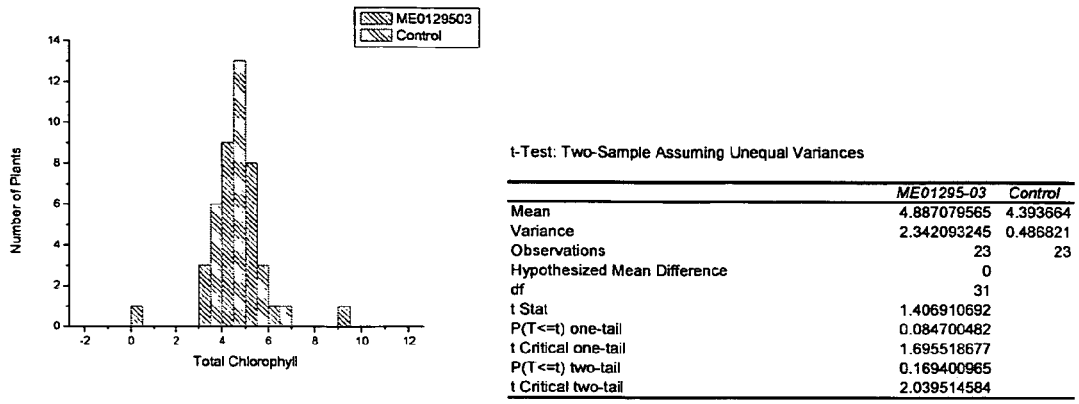

t-Test: Two-Sample Assuming Unequal Variances

|  | ME01295-03 | Control |
|---|---|---|
| Mean | 4.887079565 | 4.393664 |
| Variance | 2.342093245 | 0.486821 |
| Observations | 23 | 23 |
| Hypothesized Mean Difference | 0 | |
| df | 31 | |
| t Stat | 1.406910692 | |
| P(T<=t) one-tail | 0.084700482 | |
| t Critical one-tail | 1.695518677 | |
| P(T<=t) two-tail | 0.169400965 | |
| t Critical two-tail | 2.039514584 | |

FIGURE 3B

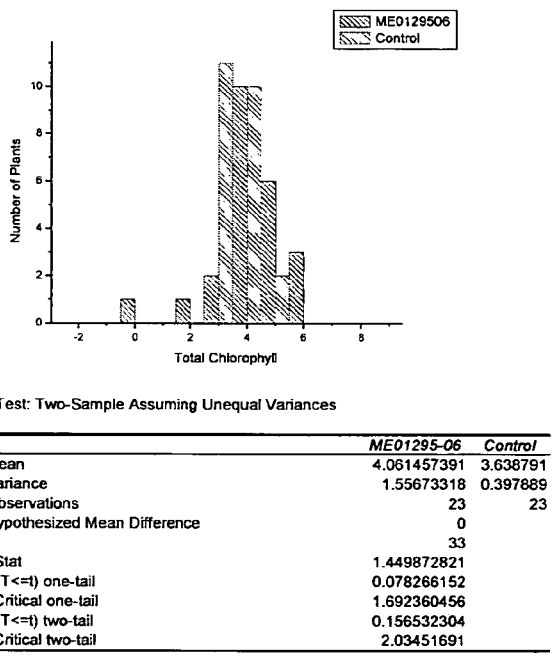

t-Test: Two-Sample Assuming Unequal Variances

|  | ME01295-06 | Control |
|---|---|---|
| Mean | 4.061457391 | 3.638791 |
| Variance | 1.55673318 | 0.397889 |
| Observations | 23 | 23 |
| Hypothesized Mean Difference | 0 | |
| df | 33 | |
| t Stat | 1.449872821 | |
| P(T<=t) one-tail | 0.078266152 | |
| t Critical one-tail | 1.692360456 | |
| P(T<=t) two-tail | 0.156532304 | |
| t Critical two-tail | 2.03451691 | |

NUCLEOTIDE SEQUENCES AND POLYPEPTIDES ENCODED THEREBY USEFUL FOR MODIFYING NITROGEN USE EFFICIENCY CHARACTERISTICS IN PLANTS

CROSS-REFERENCE TO RELATED APPLICATION

This Nonprovisional application claims priority under 35 U.S.C. §119(e) on U.S. Provisional Application No(s). 60/564,659 filed on Apr. 23, 2004, the entire contents of which are hereby incorporated by reference.

This application contains a CDR, the entire contents of which are hereby incorporated by reference. The CDR contains the following files:
File Name 2004-04-25-2750-2143PUS2.ST25.txt
Date of Creation Apr. 25, 2005
File Size 710 KB

FIELD OF THE INVENTION

The present invention relates to isolated polynucleotides, polypeptides encoded thereby, and the use of those products for making transgenic plants with improved nitrogen use efficiency. The present invention further relates to nucleotide sequences and the use of those nucleotide sequences in the genetic-engineering of plants to display enhanced nitrogen assimilatory and utilization capacities, grow larger, more efficiently or rapidly, and/or have enriched nitrogen contents in vegetative and/or reproductive plant parts and/or increased biomass. More particularly, this invention relates to producing transgenic plants engineered to have altered expression of key components in the nitrogen assimilation and utilization pathways. The engineered plants may be productively cultivated under conditions of low nitrogen fertilizer input or in nitrogen poor soils. Alternatively, the engineered plants may be used to achieve faster growing or maturing crops, higher crop yields and/or more nutritious products under ideal cultivation conditions.

BACKGROUND OF THE INVENTION

Nitrogen is often the rate-limiting element in plant growth, and all field crops have a fundamental dependence on exogenous nitrogen sources. Nitrogenous fertilizer, which is usually supplied as ammonium nitrate, potassium nitrate, or urea, typically accounts for 40% of the costs associated with crops, such as corn and wheat in intensive agriculture. Increased efficiency of nitrogen use by plants should enable the production of higher yields with existing fertilizer inputs and/or enable existing yields of crops to be obtained with lower fertilizer input, or better yields on soils of poorer quality. Also, higher amounts of proteins in the crops could also be produced more cost-effectively.

Plants have a number of means to cope with nutrient deficiencies, such as poor nitrogen availability. They constantly sense nitrogen availability in the soil and respond accordingly by modulating gene expression. Although more is being discovered about nitrogen and the components involved in regulating its uptake and utilization, much is still unknown about many of these complex interactions. For this reason, it is interesting when a gene of known or unknown function is shown to have a nitrogen response, as it opens up new possibilities and insights into nitrogen utilization and nitrogen use efficiency in a competitive environment (i.e. low and/or high nitrogen).

Plants have a number of means to cope with nutrient deficiencies. One of the most important mechanisms for doing this is to sequester or store nitrogen in times of abundance to be used later. A class of proteins likely to be involved in this process is peptide transporters. There are few published reports about plant peptide transporters indicating that they play an unexplored role in plant growth and development. Peptide transporters are carrier-mediated, energy dependent transporters. Peptides, which have been internalized to the cell, are broken down into amino acids, which are in turn are used as sources of nitrogen and carbon. Over-expression of a peptide transporter may better provide nitrogen to a plant, thus giving it an advantage in competitive nitrogen (N) environments. Use of a nitrogen assimilation inhibitor as a representation of this competitive environment provides a useful screen for candidates which have better nitrogen use efficiency (NUE). This screen provides a clear-cut method to identify N candidates in that it eliminates the subjective nature of limiting N screens based on slight increases in size and greenness.

SUMMARY OF THE INVENTION

The present invention, therefore, relates to isolated polynucleotides, polypeptides encoded thereby, and the use of those products for making transgenic plants with improved NUE.

The present invention also relates to processes for increasing the growth potential in plants due to NUE, recombinant nucleic acid molecules and polypeptides used for these processes and their uses, as well as to plants with an increased growth potential due to improved NUE.

In the field of agriculture and forestry efforts are constantly being made to produce plants with an increased growth potential in order to feed the ever-increasing world population and to guarantee the supply of reproducible raw materials. This is done conventionally through plant breeding. The breeding process is, however, both time-consuming and labor-intensive. Furthermore, appropriate breeding programs must be performed for each relevant plant species.

Progress has been made in part by the genetic manipulation of plants; that is by introducing and expressing recombinant nucleic acid molecules in plants. Such approaches have the advantage of not usually being limited to one plant species, but instead being transferable among plant species. For example, EP-A 0 511 979 describes the expression of a prokaryotic asparagine synthetase gene in plant cells that leads to increased biomass production. Likewise, WO 96/21737 describes plants with increased yield (growth potential) arising from an increase in the photosynthesis rate and the expression of deregulated or unregulated fructose-1, 6-bisphosphatase. Nevertheless, there still is a need for generally applicable processes that improve forest or agricultural plant growth potential. Therefore, the present invention relates to a process for increasing the growth potential in plants, characterized by expression of recombinant DNA molecules stably integrated into the plant genome.

It was surprisingly found that the expression of the proteins according to the invention specifically leads to an increase in growth potential.

The term "increase in growth potential" preferably relates to continued growth under low nitrogen with or without high abscissic acid, better soil recovery after exposure to low nitrogen-high abscissic acid and increased tolerance to varying nitrogen conditions. Such an increase in growth potential preferably results from an increase in NUE.

BRIEF DESCRIPTION OF THE INDIVIDUAL TABLES

Tables I-A-J provide information on each of the nucleotides of the invention including sequence information, description of the function of each sequence and experimental results. That information is presented in the following fields:

A: Report #
B: This entry provides the Ceres cDNA ID and the Ceres clone ID.
C: This entry identifies a specific function(s) that can be modulated using the gene.
D: This entry identifies which trait(s) the gene, its gene products and its homologs/orthologs modulate.
E: This entry identifies which substrait(s) the gene, its gene products and its homologs/orthologs can modulate
F: This entry summarizes the function of the gene based on expression data and the phenotype observed.
G: This entry provides a detailed discussion of the gene's use based on experimental and computer analysis.
H: This entry discusses the use of the gene, its gene products and its homolos/orthols in species other than *Arabidopsis*.
I: This entry provides the nucleic acid sequence determined from the Ceres clone data.
J: This entry provides the nucleic acid sequence determined from transformed plants.
K: This entry provides the translated protein sequence of the cDNA
L: This entry identifies public sequences that show similarity to the protein identified in field "K."
M: This entry notes any differences between the protein sequence identified in field "K" and other similar sequences identified in field "L."
N: This entry identifies protein sequences that have similar activities to the sequence protein identified in field "K." The sequences appearing in this field are identified either by the Ceres clone ID, the Ceres cDNA ID or a "gi" number. When possible, a nucleotide sequence that encodes the protein is included. Note that a particular protein can be identified by more than on "gi" number. In these cases, only one nucleotide sequence corresponding to one of the "gi" numbers in included. Other nucleotide sequences corresponding to the remaining "gi" number(s) can be found on the internet at the NCBI website.
O: This field contains sequence information for a consensus sequence derived from the ortholog sequences listed in field "N." This consensus sequence indicates which amino acid(s) appear at each position.
P: This entry identifies the promoter operably linked to the nucleic acid sequence of field "J" in the experiments that generated the phenotype data.
Q: This entry provides the ID for the plant line or event that demonstrates a statistically significant segregation ratio with respect to the observed phenotype.
R: This entry provides qualitative and quantitative data generated in the phenotype experiments. The data is organized into discrete tables, each table providing results for a particular line, test, treatment and/or event.
S: This field contains two tables (Table S-1 and Table S-2. Table 1 of this entry provides the comparison of transcription of the nucleic acid sequence of field "J" in plants subjected to various experimental conditions. Table 2 provides the parameters of each experiment noted in Table 1.
T: This field describes the materials and methods used to conduct the phenotype screening and characterization experiments.

Table II provides the results of ortholog analysis for sequences of the invention. The table is divided into four parts (A-D), each part providing the results of the analysis for one sequence. The first listed sequence in each table section describes the "Query Sequence" which was used as the search sequence to determine the existence of orthologs. The subsequent list of "Hits" provides the amino acid sequence for each protein determined to be an ortholog of the "Query Sequence". The hits were obtained from either the applicants' proprietary database (identified as "Ceres clone") or from the GENBANK public database (identified as "gi"). Each table section concludes with a consensus sequence for that ortholog group. The codes for the sequence are the same as for Table I.

It will be appreciated that while the orthologs are described in terms of their amino acid sequence, the present invention also encompasses the nucleotide sequences that code for each of the ortholog protein sequences.

Due to the degeneracy of the genetic code, different nucleotide codons may be used to code for a particular amino acid. A host cell often displays a preferred pattern of codon usage. Nucleic acid sequences are preferably constructed to utilize the codon usage pattern of the particular host cell. This generally enhances the expression of the nucleic acid sequence in a transformed host cell. Any of the above described nucleic acid and amino acid sequences may be modified to reflect the preferred codon usage of a host cell or organism in which they are contained. Modification of a nucleic acid sequence for optimal codon usage in plants is described in U.S. Pat. No. 5,689,052. Additional variations in the nucleic acid sequences may encode proteins having equivalent or superior characteristics when compared to the proteins from which they are engineered.

It is understood that certain amino acids may be substituted for other amino acids in a protein or peptide structure (and the nucleic acid sequence that codes for it) without appreciable change or loss of its biological utility or activity. For example, amino acid substitutions may be made without appreciable loss of interactive binding capacity in the antigen-binding regions of antibodies, or binding sites on substrate molecules. The modifications may result in either conservative or non-conservative changes in the amino acid sequence. The amino acid changes may be achieved by changing the codons of the nucleic acid sequence, according to the codons given in Table A.

TABLE A

CODON DEGENERACY OF AMINO ACIDS

| Amino acid | One letter | Three letter | Codons |
|---|---|---|---|
| Alanine | A | Ala | GCA GCC GCG GCT |
| Cysteine | C | Cys | TGC TGT |
| Aspartic acid | D | Asp | GAC GAT |
| Glutamic acid | E | Glu | GAA GAG |
| Phenylalanine | F | Phe | TTC TTT |
| Glycine | G | Gly | GGA GGC GGG GGT |
| Histidine | H | His | CAC CAT |
| Isoleucine | I | Ile | ATA ATC ATT |
| Lysine | K | Lys | AAA AAG |

TABLE A-continued

CODON DEGENERACY OF AMINO ACIDS

| Amino acid | One letter | Three letter | Codons |
|---|---|---|---|
| Leucine | L | Leu | TTA TTG CTA CTC CTG CTT |
| Methionine | M | Met | ATG |
| Asparagine | N | Asn | AAC AAT |
| Proline | P | Pro | CCA CCC CCG CCT |
| Glutamine | Q | Gln | CAA CAG |
| Arginine | R | Arg | AGA AGG CGA CGC CGG CGT |
| Serine | S | Ser | AGC AGT TCA TCC TCG TCT |
| Threonine | T | Thr | ACA ACC ACG ACT |
| Valine | V | Val | GTA GTC GTG GTT |
| Tryptophan | W | Trp | TGG |
| Tyrosine | Y | Tyr | TAC TAT |

It is well known in the art that one or more amino acids in a native sequence can be substituted with other amino acid(s), the charge and polarity of which are similar to that of the native amino acid, i.e., a conservative amino acid substitution, resulting in a silent change. Conservative substitutes for an amino acid within the native polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Table III provides the results of a pair-wise sequence alignment for each of the ortholog groups described in Table II specifically the alignment of the "Query Sequence" of Table II with each of its identified orthologs. The results in Table III, like those in Table II, are divided into four parts (A-D) corresponding to the results from one sequence, with the letter code of the subpart corresponding to the same letter code for the subparts in Table II.

Table IV provides the pair-wise alignment of two specific sequences of the invention.

Table V provides a summary of the invention in the various Tables for several of the sequences of the invention, correlating for each sequence the various identifiers used in the Tables (i.e. Report No., Ceres cDNA, clone ID and ME Line No.) and the location of the reported information for each sequence.

DETAILED DESCRIPTION OF THE INVENTION

1. Definitions

The following terms are utilized throughout this application:

Allelic variant: An "allelic variant" is an alternative form of the same SDF, which resides at the same chromosomal locus in the organism. Allelic variations can occur in any portion of the gene sequence, including regulatory regions. Allelic variants can arise by normal genetic variation in a population. Allelic variants can also be produced by genetic engineering methods. An allelic variant can be one that is found in a naturally occurring plant, including a cultivar or ecotype. An allelic variant may or may not give rise to a phenotypic change, and may or may not be expressed. An allele can result in a detectable change in the phenotype of the trait represented by the locus. A phenotypically silent allele can give rise to a product.

Chimeric: The term "chimeric" is used to describe genes, as defined supra, or constructs wherein at least two of the elements of the gene or construct, such as the promoter and the coding sequence and/or other regulatory sequences and/or filler sequences and/or complements thereof, are heterologous to each other.

Constitutive Promoter: Promoters referred to herein as "constitutive promoters" actively promote transcription under most, but not necessarily all, environmental conditions and states of development or cell differentiation. Examples of constitutive promoters include the cauliflower mosaic virus (CaMV) 35S transcript initiation region and the 1' or 2' promoter derived from T-DNA of *Agrobacterium tumefaciens*, and other transcription initiation regions from various plant genes, such as the maize ubiquitin-1 promoter, known to those of skill.

Coordinately Expressed: The term "coordinately expressed," as used in the current invention, refers to genes that are expressed at the same or a similar time and/or stage and/or under the same or similar environmental conditions.

Domain: Domains are fingerprints or signatures that can be used to characterize protein families and/or parts of proteins. Such fingerprints or signatures can comprise conserved (1) primary sequence, (2) secondary structure, and/or (3) three-dimensional conformation. Generally, each domain has been associated with either a family of proteins or motifs. Typically, these families and/or motifs have been correlated with specific in-vitro and/or in-vivo activities. A domain can be any length, including the entirety of the sequence of a protein. Detailed descriptions of the domains, associated families and motifs, and correlated activities of the polypeptides of the instant invention are described below. Usually, the polypeptides with designated domain(s) can exhibit at least one activity that is exhibited by any polypeptide that comprises the same domain(s).

Endogenous: The term "endogenous," within the context of the current invention refers to any polynucleotide, polypeptide or protein sequence which is a natural part of a cell or organisms regenerated from said cell.

Exogenous: "Exogenous," as referred to within, is any polynucleotide, polypeptide or protein sequence, whether chimeric or not, that is initially or subsequently introduced into the genome of an individual host cell or the organism regenerated from said host cell by any means other than by a sexual cross. Examples of means by which this can be accomplished are described below, and include *Agrobacterium*-mediated transformation (of dicots—e.g. Salomon et al. *EMBO J.* 3:141 (1984); Herrera-Estrella et al. *EMBO J.* 2:987 (1983); of monocots, representative papers are those by Escudero et al., *Plant J.* 10:355 (1996), Ishida et al., *Nature Biotechnology* 14:745 (1996), May et al., *Bio/Technology* 13:486 (1995)), biolistic methods (Armaleo et al., *Current Genetics* 17:97 1990)), electroporation, in planta techniques, and the like. Such a plant containing the exogenous nucleic acid is referred to here as a $T_0$ for the primary transgenic plant and $T_1$ for the first generation. The term "exogenous" as used herein is also intended to encompass inserting a naturally found element into a non-naturally found location.

Functionally Comparable Proteins: This phrase describes those proteins that have at least one characteristic in common. Such characteristics include sequence similarity, biochemical activity, transcriptional pattern similarity and phenotypic activity. Typically, the functionally comparable proteins share some sequence similarity or at least one biochemical and. Within this definition, homologs, orthologs and analogs are considered to be functionally comparable. In addition, functionally comparable proteins generally share at least one biochemical and/or phenotypic activity.

Gene: The term "gene," as used in the context of the current invention, encompasses all regulatory and coding sequence contiguously associated with a single hereditary unit with a genetic function. Genes can include non-coding sequences that modulate the genetic function that include, but are not limited to, those that specify polyadenylation, transcriptional regulation, DNA conformation, chromatin conformation, extent and position of base methylation and binding sites of proteins that control all of these. Genes comprised of "exons" (coding sequences), which may be interrupted by "introns" (non-coding sequences), encode proteins. A gene's genetic function may require only RNA expression or protein production, or may only require binding of proteins and/or nucleic acids without associated expression. In certain cases, genes adjacent to one another may share sequence in such a way that one gene will overlap the other. A gene can be found within the genome of an organism, artificial chromosome, plasmid, vector, etc., or as a separate isolated entity.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence originates from, are considered heterologous to said coding sequence. Elements operatively linked in nature and contiguous to each other are not heterologous to each other. On the other hand, these same elements remain operatively linked but become heterologous if one filler sequence is placed between them. Thus, the promoter and coding sequences of a corn gene expressing an amino acid transporter are not heterologous to each other, but the promoter and coding sequence of a corn gene operatively linked in a novel manner are heterologous.

High Nitrogen Conditions: This phrase refers to a total nitrogen concentration of 240 mM (e.g. $KNO_3$ and $NH_4NO_3$ combined).

Homologous gene: In the current invention, "homologous gene" refers to a gene that shares sequence similarity with the gene of interest. This similarity may be in only a fragment of the sequence and often represents a functional domain such as, examples including without limitation a DNA binding domain, a domain with tyrosine kinase activity, or the like. The functional activities of homologous genes are not necessarily the same.

Inducible Promoter: An "inducible promoter" in the context of the current invention refers to a promoter which is regulated under certain conditions, such as light, chemical concentration, protein concentration, conditions in an organism, cell, or organelle, etc. A typical example of an inducible promoter, which can be utilized with the polynucleotides of the present invention, is PARSK1, the promoter from the *Arabidopsis* gene encoding a serine-threonine kinase enzyme, and which promoter is induced by dehydration, abscissic acid and sodium chloride (Wang and Goodman, *Plant J.* 8:37 (1995)). Examples of environmental conditions that may affect transcription by inducible promoters include anaerobic conditions, elevated temperature, or the presence of light.

Low Nitrogen Conditions: The phrase "low nitrogen conditions" refers to either a concentration of 100 µM $KNO_3$ or 100-300 µM total nitrogen (e.g. $KNO_3$ and $NH_4NO_3$ combined).

Masterpool: The term "masterpool" as used in these experiments is a pool of seeds from five different plants. Each of these plants has been transformed with the same promoter/cDNA combination. An equal number of seeds from each plant is used to make up the pool.

Misexpression: The term "misexpression" refers to an increase or a decrease in the transcription of a coding region into a complementary RNA sequence as compared to the wild-type. This term also encompasses expression of a gene or coding region for a different time period as compared to the wild-type and/or from a non-natural location within the plant genome.

Nitrogen Assimilation Inhibitor: The term "nitrogen assimilation inhibitor" refers to a compound, polypeptide or protein that interferes with the conversion of ammonium to usable nitrogen (e.g. glutamine) or the feedback inhibition pathway that results in cessation of nitrogen uptake when nitrogen pools accumulate. Examples of nitrogen assimilation inhibitors are Methionine sulfoximine (MSX; blocks conversion of ammonium to glutamine), Azaserine (a glutamine amidotransferase inhibitor) and Albizzin (a glutamase inhibitor).

Normal Nitrogen Conditions: This phrase refers to the total nitrogen present in standard MSO media, 60 mM.

Orthologous Gene: In the current invention "orthologous gene" refers to a second gene that encodes a gene product that performs a similar function as the product of a first gene. The orthologous gene may also have a degree of sequence similarity to the first gene. The orthologous gene may encode a polypeptide that exhibits a degree of sequence similarity to a polypeptide corresponding to a first gene. The sequence similarity can be found within a functional domain or along the entire length of the coding sequence of the genes and/or their corresponding polypeptides.

Percentage of sequence identity: "Percentage of sequence identity," as used herein, is determined by comparing two optimally aligned sequences over a comparison window, where the fragment of the polynucleotide or amino acid sequence in the comparison window may comprise additions or deletions (e.g., gaps or overhangs) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Optimal alignment of sequences for comparison may be conducted by the local homology algorithm of Smith and Waterman *Add. APL. Math.* 2:482 (1981), by the homology alignment algorithm of Needleman and Wunsch *J. Mol. Biol.* 48:443 (1970), by the search for similarity method of Pearson and Lipman *Proc. Natl. Acad. Sci.* (*USA*) 85: 2444 (1988), by computerized implementations of these algorithms (GAP, BESTFIT, BLAST, PASTA, and TFASTA in the Wisconsin Genetics Software Package, Genetics Computer Group (GCG), 575 Science Dr., Madison, Wis.), or by inspection. Given that two sequences have been identified for comparison, GAP and BESTFIT are preferably employed to determine their optimal alignment. Typically, the default values of 5.00 for gap weight and 0.30 for gap weight length are used. The term "substantial sequence identity" between polynucleotide or polypeptide sequences refers to polynucleotide or polypeptide comprising a sequence that has at least 80% sequence identity, preferably at least 85%, more preferably at least 90% and most preferably at least 95%, even more preferably, at least 96%, 97%, 98% or 99% sequence identity compared to a reference sequence using the programs.

Plant Promoter: A "plant promoter" is a promoter capable of initiating transcription in plant cells and can drive or facilitate transcription of a fragment of the SDF of the instant invention or a coding sequence of the SDF of the instant invention. Such promoters need not be of plant origin. For example, promoters derived from plant viruses, such as the CaMV35S promoter or from *Agrobacterium tumefaciens* such as the T-DNA promoters, can be plant promoters. A typical example of a plant promoter of plant origin is the maize ubiquitin-1 (ubi-1) promoter known to those of skill.

Promoter: The term "promoter," as used herein, refers to a region of sequence determinants located upstream from the start of transcription of a gene and which are involved in recognition and binding of RNA polymerase and other proteins to initiate and modulate transcription. A basal promoter is the minimal sequence necessary for assembly of a transcription complex required for transcription initiation. Basal promoters frequently include a "TATA box" element usually located between 15 and 35 nucleotides upstream from the site of initiation of transcription. Basal promoters also sometimes include a "CCAAT box" element (typically a sequence CCAAT) and/or a GGGCG sequence, usually located between 40 and 200 nucleotides, preferably 60 to 120 nucleotides, upstream from the start site of transcription.

Regulatory Sequence: The term "regulatory sequence," as used in the current invention, refers to any nucleotide sequence that influences transcription or translation initiation and rate, and stability and/or mobility of the transcript or polypeptide product. Regulatory sequences include, but are not limited to, promoters, promoter control elements, protein binding sequences, 5' and 3' UTRs, transcriptional start site, termination sequence, polyadenylation sequence, introns, certain sequences within a coding sequence, etc.

Signal Peptide: A "signal peptide" as used in the current invention is an amino acid sequence that targets the protein for secretion, for transport to an intracellular compartment or organelle or for incorporation into a membrane. Signal peptides are indicated in the tables and a more detailed description located below.

Specific Promoter: In the context of the current invention, "specific promoters" refers to a subset of inducible promoters that have a high preference for being induced in a specific tissue or cell and/or at a specific time during development of an organism. By "high preference" is meant at least 3-fold, preferably 5-fold, more preferably at least 10-fold still more preferably at least 20-fold, 50-fold or 100-fold increase in transcription in the desired tissue over the transcription in any other tissue. Typical examples of temporal and/or tissue specific promoters of plant origin that can be used with the polynucleotides of the present invention, are: PTA29, a promoter which is capable of driving gene transcription specifically in tapetum and only during anther development (Koltonow et al., Plant Cell 2:1201 (1990); RCc2 and RCc3, promoters that direct root-specific gene transcription in rice (Xu et al., *Plant Mol. Biol.* 27:237 (1995); TobRB27, a root-specific promoter from tobacco (Yamamoto et al., *Plant Cell* 3:371 (1991)). Examples of tissue-specific promoters under developmental control include promoters that initiate transcription only in certain tissues or organs, such as root, ovule, fruit, seeds, or flowers. Other suitable promoters include those from genes encoding storage proteins or the lipid body membrane protein, oleosin. A few root-specific promoters are noted above.

Stringency: "Stringency" as used herein is a function of probe length, probe composition (G+C content), and salt concentration, organic solvent concentration, and temperature of hybridization or wash conditions. Stringency is typically compared by the parameter $T_m$, which is the temperature at which 50% of the complementary molecules in the hybridization are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship of hybridization conditions to $T_m$ (in ° C.) is expressed in the mathematical equation $$T_m = 81.5 - 16.6(\log_{10}[Na^+]) + 0.41(\% \text{ G+C}) - (600/N) \tag{1}$$

where N is the length of the probe. This equation works well for probes 14 to 70 nucleotides in length that are identical to the target sequence. The equation below for $T_m$ of DNA-DNA hybrids is useful for probes in the range of 50 to greater than 500 nucleotides, and for conditions that include an organic solvent (formamide).

$$T_m = 81.5 + 16.6 \log\{[Na^+]/(1+0.7[Na^+])\} + 0.41(\% \text{ G+C}) - 500/L \, 0.63(\% \text{ formamide}) \tag{2}$$

where L is the length of the probe in the hybrid. (P. Tijessen, "Hybridization with Nucleic Acid Probes" in Laboratory Techniques in Biochemistry and Molecular Biology, P. C. vand der Vliet, ed., c. 1993 by Elsevier, Amsterdam.) The $T_m$ of equation (2) is affected by the nature of the hybrid; for DNA-RNA hybrids $T_m$ is 10-15° C. higher than calculated, for RNA-RNA hybrids $T_m$ is 20-25° C. higher. Because the $T_m$ decreases about 1° C. for each 1% decrease in homology when a long probe is used (Bonner et al., *J. Mol. Biol.* 81:123 (1973)), stringency conditions can be adjusted to favor detection of identical genes or related family members.

Equation (2) is derived assuming equilibrium and therefore, hybridizations according to the present invention are most preferably performed under conditions of probe excess and for sufficient time to achieve equilibrium. The time required to reach equilibrium can be shortened by inclusion of a hybridization accelerator such as dextran sulfate or another high volume polymer in the hybridization buffer.

Stringency can be controlled during the hybridization reaction or after hybridization has occurred by altering the salt and temperature conditions of the wash solutions used. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

Substantially free of: A composition containing A is "substantially free of" B when at least 85% by weight of the total A+B in the composition is A. Preferably, A comprises at least about 90% by weight of the total of A+B in the composition, more preferably at least about 95% or even 99% by weight.

For example, a plant gene or DNA sequence can be considered substantially free of other plant genes or DNA sequences.

Superpool: As used in the context of the current invention, a "superpool" refers to a mixture of equal amounts of seed from 00 different masterpools. Thus, the superpool contains an equal amount of seed from 500 different plants, but only represents 100 cDNAs because each masterpool is composed of seed from 5 different transformed plants each containing the same cDNA.

$T_1$: As used in the current application, the term $T_1$ refers to the cell or plant that is the direct result of a transformation experiment $T_2$: As used in the current application, the term T2 refers to the progeny of the cell or plant that is the direct result of a transformation experiment.

$T_3$: As used in the current application, the term $T_3$ refers to second generation progeny of the cell or plant that is the direct result of a transformation experiment.

Translational start site: In the context of the current invention, a "translational start site" is usually an ATG in the cDNA transcript, more usually the first ATG. A single cDNA, however, may have multiple translational start sites.

Transcription start site: "Transcription start site" is used in the current invention to describe the point at which transcription is initiated. This point is typically located about 25 nucleotides downstream from a TFIID binding site, such as a TATA box. Transcription can initiate at one or more sites within the gene, and a single gene may have multiple transcriptional start sites, some of which may be specific for transcription in a particular cell-type or tissue.

Untranslated region (UTR): A "UTR" is any contiguous series of nucleotide bases that is transcribed, but is not translated. These untranslated regions may be associated with particular functions such as increasing mRNA message stability. Examples of UTRs include, but are not limited to polyadenylation signals, terminations sequences, sequences located between the transcriptional start site and the first exon (5' UTR) and sequences located between the last exon and the end of the mRNA (3' UTR).

Variant: The term "variant" is used herein to denote a polypeptide or protein or polynucleotide molecule that differs from others of its kind in some way. For example, polypeptide and protein variants can consist of changes in amino acid sequence and/or charge and/or post-translational modifications (such as glycosylation, etc).

Varying Nitrogen Conditions: In the context of the instant invention, the phrase "varying nitrogen conditions" refers to growth conditions where the concentration of available nitrogen is in flux. This phrase encompasses situations where the available nitrogen concentration is initially low, but increases to normal or high levels as well as situations where the initial available nitrogen concentration is high, but then falls to normal or low levels. Situations involving multiple changes in available nitrogen concentration, such as fluctuations from low to high to low levels, are also encompassed by this phrase. These available nitrogen concentration changes can occur in a gradual or punctuated manner.

Zero Nitrogen Conditions: This phrase refers to a total nitrogen concentration of 0 mM.

2. Important Characteristics of the Polynucleotides of the Invention

The genes and polynucleotides of the present invention are of interest because when they are misexpressed (i.e. when expressed at a non-natural location or in an increased or decreased amount) they produce plants with modified NUE as discussed below and as evidenced by the results of differential expression and misexpression experiments. These traits can be used to exploit or maximize plant products. For example, the genes and polynucleotides of the present invention are used to increase the expression of nitrate and ammonium transporter gene products. These transporter gene products increase the uptake of nitrogen and transport of nitrogen from roots to shoots, which leads to an increase in the amount of nitrogen available for reduction to ammonia. As a consequence, such transgenic plants require less fertilizer, leading to reduced costs for the farmer and less nitrate pollution in ground water.

The nitrogen responsive nucleic acids of the invention also down-regulate genes that lead to feedback inhibition of nitrogen uptake and reduction. An example of such genes are those encoding the 14-3-3 proteins, which repress nitrate reductase (Swiedrych A et al., 2002, J Agric Food Chem 27; 50(7): 2137-41. Repression of the 14-3-3 gene affects the amino acid and mineral composition of potato tuber). Antisense expression of these in transgenic plants cause an increase in amino acid content and protein content in the seed and/or leaves. Such plants are especially useful for livestock feed. For example, an increase in amino acid and/or protein content in alfalfa provides an increase in forage quality and thus enhanced nutrition.

3. The Genes of the Invention

The sequences of the invention were isolated from plants especially *Arabidopsis thaliana, Glycine max, Orgza sativa* and *Zea mays.*

The nucleotide sequence of the present invention modulate biomass and growth rate in transformed plants. Misexpression of the sequences leads to an increase in amino acid, peptide and protein production in the plant, resulting in increased nutritional value. Such plants are useful for superior fraje and fadotucks. Transformed plants exhibiting over expression of the genes of the invention grow well under low nitrogen conditions, and exhibit increased tolerance to varying nitrogen conditions these require less fertilization, leading to lower costs for the farmer and reduced nitrate pollution of ground water.

The nucleotide sequences for the invention are considered to encode transport proteins. Without being tied to any theory, it is believed that expression of the transporter gene helps to increase transport from storage tissue to the meristem and developing leaves to delay of seeds. These genes, therefore, can make plants insensitive to ambient nitrogen, enabling changes in fertility functions.

A competitive environment can be simulated by using a nitrogen (N) assimilation inhibitor and provides a useful screen to identify genes that have better nitrogen use efficiency (NUE). The ensuing selection provides a clear-cut screen for N genes by eliminating the subjective nature of experiments that rely on limiting N and identifying plants with slight increases in size and greenness.

Nitrogen assimilation inhibitor screens are based on the fact that under normal conditions ammonium is converted into glutamine by glutamine synthetase (FIG. 1). When N pools accumulate, ammonium uptake is turned off by feedback regulation. But an inhibitor of glutamine synthetase, such as methionine sulfoximine (MSX), blocks the conversion of ammonium to glutamine and affects the biosynthesis of major nitrogen containing compounds such as amino acids, nucleotides, chlorophylls, polyamines, and alkaloids (FIG. 1). Thus, growing plants in the presence of a N assimilation inhibitor allows identification of plants that are mis-expressing a gene(s) and as a consequence have improved NUE, independent of the available N in the soil. Such "mis-expressers" are identified by an increase in greenness and longer roots as compared to wild-type.

The invention has utility in improving important agronomic characteristics of crop plants. One of the improvements would be the ability of the engineered plants to be productively cultivated with lower nitrogen fertilizer inputs and on nitrogen-poor soil. Additional improvements include more vigorous (i.e., faster) growth as well as greater vegetative and/or reproductive yield under normal cultivation conditions (i.e., non-limiting nutrient conditions). To achieve these same improvements, traditional crop breeding methods would require screening large segregating populations. The present invention circumvent the need for such large scale screening by producing plants many of which, if not most, would have the desired characteristics.

According to the present invention, achieving the desired plant improvements may require, in some instances, the ectopic overexpression of a single gene or multiple genes. The modified expression may involve engineering the plant with any or several of the following: a) a transgene in which the coding sequence is operably associated to a strong, constitutive promoter; b) additional copies of the native gene encoding the desired component; c) regulatory gene(s) that activates the expression of the desired gene(s) for nitrogen assimilation or utilization; d) a copy of the native gene that has its regulatory region modified for enhanced expression; and e) a transgene which expresses a mutated, altered or chimeric version of a nitrogen assimilation or utilization component.

In other instances, achieving the desired plant improvements may require altering the expression pattern of a nitrogen assimilation or utilization component. The altered expression pattern may involve engineering the plant with any or many of the following: a) a transgene in which the coding sequence is operably associated to a promoter with the desired expression pattern (such promoters may include those considered to have tissue or developmental-specific expression patterns); b) modified regulatory genes that activates the expression of the encoding gene in the preferred pattern; c) a native copy of the enzyme-encoding gene that has its regulatory region modified to express in the preferred pattern.

In yet other instances, achieving the desired plant improvements may require suppressing the expression level and/or pattern of a nitrogen assimilation or utilization component. The suppression of expression may involve engineering the plant with genes encoding antisense RNAs, ribozymes, co-suppression constructs, or "dominant negative" mutations (see Herskowitz, 1987, Nature 329:219-222 for an explanation of the mechanism of gene suppression by dominant negative mutations). Further, gene suppression may also be achieved by engineering the plant with a homologous recombination construct that replaces the native gene with a copy of a defective gene or enzyme-encoding sequence that is under the control of a promoter with the desired expression level and/or pattern.

In all instances, a plant with the desired improvement can be isolated by screening the engineered plants for altered expression pattern or level of the nitrogen assimilation or utilization component, altered expression pattern or level of the corresponding mRNA or protein, altered nitrogen assimilation or utilization capacities, increased growth rate, enhanced vegetative yield, or improved reproductive yields (e.g., more or larger seeds or fruits). The screening of the engineered plants may involve assays and immunoassays to measure enzyme/protein levels; Northern analysis, RNase protection, primer extension, reverse transcriptase/PCR, etc. to measure mRNA levels; measuring the amino acid composition, free amino acid pool or total nitrogen content of various plant tissues; measuring growth rates in terms of fresh weight gains over time; or measuring plant yield in terms of total dry weight and/or total seed weight.

4. Use of the Genes to Make Transgenic Plants 4.1. Nucleic Acid Constructs

The properties of the nucleic acid sequences are varied as are the genetic structures of various potential host plant cells. The preferred embodiments of the present invention will describe a number of features which an artisan may recognize as not being absolutely essential, but clearly advantageous. These include methods of isolation, synthesis or construction of gene constructs, the manipulations of the gene constructs to be introduced into plant cells, certain features of the gene constructs, and certain features of the vectors associated with the gene constructs.

Further, the gene constructs of the present invention may be encoded on DNA or RNA molecules. According to the present invention, it is preferred that the desired, stable genotypic change of the target plant be effected through genomic integration of exogenously introduced nucleic acid construct(s), particularly recombinant DNA constructs. Nonetheless, according to the present inventions, such genotypic changes can also be effected by the introduction of episomes (DNA or RNA) that can replicate autonomously and that are somatically and germinally stable. Where the introduced nucleic acid constructs comprise RNA, plant transformation or gene expression from such constructs may proceed through a DNA intermediate produced by reverse transcription.

The nucleic acid constructs described herein can be produced using methods well known to those skilled in the art. Artisans can refer to sources like Sambrook et al., 1989, Molecular Cloning: a laboratory manual, Cold Spring Harbor Laboratory Press, Plainview, N.Y. for teachings of recombinant DNA methods that can be used to isolate, characterize, and manipulate the components of the constructs as well as to built the constructs themselves. In some instances, where the nucleic acid sequence of a desired component is known, it may be advantageous to synthesize it rather than isolating it from a biological source. In such instances, an artisan can refer to teachings of the likes of Caruthers et al., 1980, Nuc. Acids Res. Symp. Ser. 7:215-233, and of Chow and Kempe, 1981, Nuc. Acids Res. 9:2807-2817. In other instances, the desired components may be advantageously produced by polymerase chain reaction (PCR) amplification. For PCR teachings, an artisan can refer to the like of Gelfand, 1989, PCR Technology, Principles and Applications for DNA Amplification, H. A. Erlich, ed., Stockton Press, N.Y., Current Protocols In Molecular Biology, Vol. 2, Ch. 15, Ausubel et al. eds., John Wiley & Sons, 1988.

Expression Constructs

In accordance to the present invention, a plant with ectopic overexpression of a nitrogen assimilation or utilization component may be engineered by transforming a plant cell with a gene construct comprising a plant promoter operably associated with a sequence encoding the desired component. (Operably associated is used herein to mean that transcription controlled by the "associated" promoter would produce a functional messenger RNA, whose translation would produce the component.) In a preferred embodiment of the present invention, the associated promoter is a strong and non tissue- or developmental-specific plant promoter (e.g. a promoter that strongly expresses in many or all tissue types). Examples of such strong, "constitutive" promoters include, but are not limited to, the CaMV 35S promoter, the T-DNA mannopine synthetase promoter, and their various derivatives.

In another embodiment of the present invention, it may be advantageous to engineer a plant with a gene construct operably associating a tissue- or developmental-specific promoter with a sequence encoding the desired component. For example, where expression in photosynthetic tissues and organs are desired, promoters such as those of the ribulose bisphosphate carboxylase (RUBISCO) genes or chlorophyll a/b binding protein (CAB) genes may be used; where expression in seed is desired, promoters such as those of the various seed storage protein genes may be used; where expression in nitrogen fixing nodules is desired, promoters such those of the legehemoglobin or nodulin genes may be used; where root specific expression is desired, promoters such as those encoding for root-specific glutamine synthetase genes may be used (see Tingey et al., 1987, EMBO J. 6:1-9; Edwards et al., 1990, Proc. Nat. Acad. Sci. USA 87:3459-3463).

In an additional embodiment of the present invention, it may be advantageous to transform a plant with a gene construct operably associating an inducible promoter with a sequence encoding the desired component. Examples of such promoters are many and varied. They include, but are not limited to, those of the heat shock genes, the defense responsive gene (e.g., phenylalanine ammonia lyase genes), wound induced genes (e.g., hydroxyproline rich cell wall protein genes), chemically-inducible genes (e.g., nitrate reductase genes, gluconase genes, chitinase genes, etc.), dark-inducible genes to name just a few.

In yet another embodiment of the present invention, it may be advantageous to transform a plant with a gene construct operably linking a modified or artificial promoter to a sequence encoding the desired component. Typically, such promoters, constructed by recombining structural elements of different promoters, have unique expression patterns and/or levels not found in natural promoters. See e.g., Salina et al., 1992, Plant Cell 4:1485-1493, for examples of artificial promoters constructed from combining cis-regulatory elements with a promoter core.

In yet an additional embodiment of the present invention, the ectopic overexpression of a nitrogen assimilation or utilization component may be engineered by increasing the copy number of the gene encoding the desired component. One approach to producing a plant cell with increased copies of the desired gene is to transform with nucleic acid constructs that contain multiple copies of the gene. Alternatively, a gene encoding the desired component can be placed in a nucleic acid construct containing an amplification-selectable marker (ASM) gene such as the glutamine synthetase or dihydrofolate reductase gene. Cells transformed with such constructs is subjected to culturing regimes that select cell lines with increased copies of ASK gene. See Donn et al., 1984, J. Mol. Appl. Genet. 2:549-562, for a selection protocol used to isolate of a plant cell line containing amplified copies of the GS gene. Because the desired gene is closely linked to the ASH gene, cell lines that amplified the ASH gene would also likely to have amplified the gene encoding the desired component.

In one more embodiment of the present invention, the ectopic overexpression of a nitrogen assimilation or utilization component may be engineered by transforming a plant cell with nucleic acid construct encoding a regulatory gene that controls the expression of the endogenous gene or an transgene encoding the desired component, wherein the introduced regulatory gene is modified to allow for strong expression of the component in the desired tissues and/or developmental stages. synthetase promoter, and their various derivatives.

Suppression Constructs

In accordance to the present invention, a desired plant may be engineered by suppressing GS activity or the activities of other components in nitrogen assimilation/metabolism (FIG. 1). In an embodiment, the suppression may be engineered by transforming a plant cell with a gene construct encoding an antisense RNA complementary to a segment or the whole of a host target RNA transcript, including the mature target mRNA. In another embodiment, target gene (e.g., GS mRNA) suppression may be engineered by transforming a plant cell with a gene construct encoding a ribozyme that cleaves a host target RNA transcript, (e.g., GS RNA transcript, including the mature GS mRNA).

In yet another embodiment, target gene suppression may be engineered by transforming a plant cell with a gene construct encoding the target component containing a "dominant negative" mutation. Preferred mutations are those affecting catalysis, substrate binding (e.g., for GS, the binding site of glutamate or ammonium ion), or product release. A useful mutation may be a deletion or point-mutation of the critical residue(s) involved with the above-mentioned processes. An artisan can refer to teachings herein and of Herskowitz (Nature, 329:219-222, 1987) for approaches and strategies to constructing dominant negative mutations.

For all of the aforementioned suppression constructs, it is preferred that such gene constructs express with the same tissue and developmental specificity as the target gene. Thus, it is preferred that these suppression constructs be operatively associated with the promoter of the target gene. Alternatively, it may be preferred to have the suppression constructs expressed constitutively. Thus, a strong, constitute promoter, such as the CaMV 35S promoter, may also be used to express the suppression constructs. A most preferred promoter for these suppression constructs is a modified promoter of the target gene, wherein the modification results in enhanced expression of the target gene promoter without changes in the tissue or developmental specificities.

In accordance with the present invention, desired plants with suppressed target gene expression may also be engineered by transforming a plant cell with a co-suppression construct. A co-suppression construct comprises a functional promoter operatively associated with a complete or partial coding sequence of the target gene. It is preferred that the operatively associated promoter be a strong, constitutive promoter, such as the CaMV 35S promoter. Alternatively, the co-suppression construct promoter can be one that expresses with the same tissue and developmental specificity as the target gene. Such alternative promoters could include the promoter of the target gene itself (e.g., a GS promoter to drive the expression of a GS co-suppression construct).

According to the present invention, it is preferred that the co-suppression construct encodes a incomplete target mRNA or defective target enzyme, although a construct encoding a fully functional target RNA or enzyme may also be useful in effecting co-suppression.

In embodiments, where suppression of most, if not all, GS isozymes is desired, it is preferred that the co-suppression construct encodes a complete or partial copy of chloroplastic GS mRNA (e.g., pea GS2 mRNA). As disclosed herein (section 6.2.2.), such constructs are particularly effective in suppressing the expression of the target gene.

In accordance with the present invention, desired plants with suppressed target gene expression may also be engineered by transforming a plant cell with a construct that can effect site-directed mutagenesis of the endogenous target gene. (See Offring a et al., 1990, EMBO J. 9:3077-84; and Kanevskii et al., 1990, Dokl. Akad. Nauk. SSSR 312:1505-1507) for discussions of nucleic constructs for effecting site-directed mutagenesis of target genes in plants.) It is preferred that such constructs effect suppression of target gene by replacing the endogenous target gene sequence through homologous recombination with none or inactive coding sequence.

Other Features of Recombinant Nucleic Acid Constructs

The recombinant construct of the present invention may include a selectable marker for propagation of the construct. For example, a construct to be propagated in bacteria preferably contains an antibiotic resistance gene, such as one that confers resistance to kanamycin, tetracycline, streptomycin, or chloramphenicol. Suitable vectors for propagating the construct include plasmids, cosmids, bacteriophages or viruses, to name but a few.

In addition, the recombinant constructs may include plant-expressible selectable or screenable marker genes for isolating, identifying or tracking of plant cells transformed by these constructs. Selectable markers include, but are not limited to, genes that confer antibiotic resistances (e.g., resistance to kanamycin or hygromycin) or herbicide resistance (e.g., resistance to sulfonylurea, phosphinothricin, or glyphosate). Screenable markers include, but are not limited to, the genes encoding .beta.-glucuronidase (Jefferson, 1987, Plant Molec Biol. Rep 5:387-405), luciferase (Ow et al., 1986, Science 234:856-859), B and C1 gene products that regulate anthocyanin pigment production (Goff et al., 1990, EMBO J. 9:2517-2522).

In embodiments of the present invention which utilize the *Agrobacterium* system for transforming plants (see infra), the recombinant DNA constructs additionally comprise at least the right T-DNA border sequence flanking the DNA sequences to be transformed into plant cell. In preferred embodiments, the sequences to be transferred in flanked by the right and left T-DNA border sequences. The proper design and construction of such T-DNA based transformation vectors are well known to those skilled in the art.

To use the sequences of the present invention or a combination of them or parts and/or mutants and/or fusions and/or variants of them, recombinant DNA constructs are prepared which comprise the polynucleotide sequences of the invention inserted into a vector, and which are suitable for transformation of plant cells. The construct can be made using standard recombinant DNA techniques (Sambrook et al. 1989) and can be introduced to the species of interest by *Agrobacterium*-mediated transformation or by other means of transformation as referenced below.

The vector backbone can be any of those typical in the art such as plasmids, viruses, artificial chromosomes, BACs, YACs and PACs and vectors of the sort described by
(a) BAC: Shizuya et al., Proc. Natl. Acad. Sci. USA 89: 8794-8797 (1992); Hamilton et al., Proc. Natl. Acad. Sci. USA 93: 9975-9979 (1996);
(b) YAC: Burke et al., Science 236:806-812 (1987);
(c) PAC: Sternberg N. et al., Proc Natl Acad Sci USA. January; 87(1):103-7 (1990);
(d) Bacteria-Yeast Shuttle Vectors: Bradshaw et al., Nucl Acids Res 23: 4850-4856 (1995);
(e) Lambda Phage Vectors: Replacement Vector, e.g., Frischauf et al., J. Mol. Biol 170: 827-842 (1983); or Insertion vector, e.g., Huynh et al., In: Glover N M (ed) DNA Cloning: A practical Approach, Vol. 1 Oxford: IRL Press (1985); T-DNA gene fusion vectors: Walden et al., Mol Cell Biol 1: 175-194 (1990); and
(g) Plasmid vectors: Sambrook et al., infra.

Typically, the construct comprises a vector containing a sequence of the present invention with any desired transcriptional and/or translational regulatory sequences, such as promoters, UTRs, and 3' end termination sequences. Vectors can also include origins of replication, scaffold attachment regions (SARs), markers, homologous sequences, introns, etc. The vector may also comprise a marker gene that confers a selectable phenotype on plant cells. The marker typically encodes biocide resistance, particularly antibiotic resistance, such as resistance to kanamycin, G418, bleomycin, hygromycin, or herbicide resistance, such as resistance to chlorosulfuron or phosphinotricin.

A plant promoter fragment is used that directs transcription of the gene in all tissues of a regenerated plant and may be a constitutive promoter, such as 35S. Alternatively, the plant promoter directs transcription of a sequence of the invention in a specific tissue (tissue-specific promoters) or is otherwise under more precise environmental control (inducible promoters).

If proper polypeptide production is desired, a polyadenylation region at the 3'-end of the coding region is typically included. The polyadenylation region can be derived from the natural gene, from various other plant genes, or from T-DNA.

Knock-In Constructs

Ectopic expression of the sequences of the invention is also accomplished using a "knock-in" approach. Here, the first component, an "activator line," is a transgenic plant comprising a transcriptional activator operatively linked to a promoter. The second component comprises the desired cDNA sequence operatively linked to the target binding sequence/region of the transcriptional activator. The second component is transformed into the "activator line" or is used to transform a host plant to produce a "target" line that is crossed with the "activator line" by ordinary breeding methods. In either case, the result is the same. That is, the promoter drives production of the transcriptional activator protein that then binds to the target binding region to facilitate expression of the desired cDNA.

Any promoter that functions in plants can be used in the first component, such as the 35S Cauliflower Mosaic Virus promoter or a tissue or organ specific promoter. Suitable transcriptional activator polypeptides include, but are not limited to, those encoding HAP1 and GAL4. The binding sequence recognized and targeted by the selected transcriptional activator protein is used in the second component.

Transformation

Techniques for transforming a wide variety of higher plant species are well known and described in the technical and scientific literature. See, e.g. Weising et al., *Ann. Rev. Genet.* 22:421 (1988); and Christou, Euphytica, v. 85, n.1-3:13-27, (1995).

The person skilled in the art knows processes for the transformation of monocotyledonous and dicotyledonous plants. A variety of techniques are available for introducing DNA into a plant host cell. These techniques comprise transformation of plant cells by DNA injection, DNA electroporation, use of bolistics methods, protoplast fusion and via T-DNA using *Agrobacterium tumefaciens* or *Agrobacterium rhizogenes*, as well as further possibilities.

DNA constructs of the invention are introduced into the genome of the desired plant host by a variety of conventional techniques. For example, the DNA construct is introduced directly into the genomic DNA of the plant cell using techniques such as electroporation, microinjection and polyethylene glycol precipitation of plant cell protoplasts or protoplast fusion. Electroporation techniques are described in Fromm et al. *Proc. Natl. Acad. Sci. USA* 82:5824 (1985). Microinjection techniques are known in the art and well described in the scientific and patent literature. The plasmids do not have to fulfill specific requirements for use in DNA electroporation or DNA injection into plant cells. Simple plasmids such as pUC derivatives can be used.

The introduction of DNA constructs using polyethylene glycol precipitation is described in Paszkowski et al. *EMBO J.* 3:2717 (1984). Introduction of foreign DNA using protoplast fusion is described by Willmitzer (Willmitzer, L., 1993 Transgenic plants. In: Biotechnology, A Multi-Volume Comprehensive Treatise (H. J. Rehm, G. Reed, A. Paler, P. Stadler, eds.), Vol. 2, 627-659, VCH Weinheim-New York-Basel-Cambridge).

Alternatively, the DNA constructs of the invention are introduced directly into plant tissue using ballistic methods, such as DNA particle bombardment. Ballistic transformation techniques are described in Klein et al. *Nature* 327:773 (1987). Introduction of foreign DNA using ballistics is described by Willmitzer (Willmitzer, L., 1993 Transgenic plants. In: Biotechnology, A Multi-Volume Comprehensive Treatise (H. J. Rehm, G. Reed, A. Pühler, P. Stadler, eds.), Vol. 2, 627-659, VCH Weinheim-New York-Basel-Cambridge).

DNA constructs are also introduced with the help of *Agrobacteria*. The use of *Agrobacteria* for plant cell transformation is extensively examined and sufficiently disclosed in the specification of EP-A 120 516, and in Hoekema (In: The Binary Plant Vector System Offsetdrukkerij Kanters B. V., Alblasserdam (1985), Chapter V), Fraley et al. (Crit. Rev. Plant. Sci. 4, 1-46) and An et al. (EMBO J. 4 (1985), 277-287). Using this technique, the DNA constructs of the invention are combined with suitable T-DNA flanking regions and introduced into a conventional *Agrobacterium tumefaciens* host vector. The virulence functions of the *Agrobacterium tumefaciens* host direct the insertion of the construct and adjacent marker(s) into the plant cell DNA when the cell is infected by the bacteria (McCormac et al., 1997, *Mol. Biotechnol.* 8:199; Hamilton, 1997, *Gene* 200:107; Salomon et al., 1984 *EMBO J.* 3:141; Herrera-Estrella et al., 1983 *EMBO J.* 2:987). *Agrobacterium tumefaciens*-mediated transformation techniques, including disarming and use of binary or co-integrate vectors, are well described in the scientific literature. See, for example Hamilton, C M., *Gene* 200:107 (1997); Müller et al. *Mol. Gen. Genet.* 207:171 (1987); Komari et al. *Plant J.* 10:165 (1996); Venkateswarlu et al. *Biotechnology* 9:1103 (1991) and Gleave, A P., *Plant Mol. Biol.* 20:1203 (1992); Graves and Goldman, *Plant Mol. Biol.* 7:34 (1986) and Gould et al., *Plant Physiology* 95:426 (1991).

For plant cell T-DNA transfer of DNA, plant explants, plant cells that have been cultured in suspension or protoplasts are co-cultivated with *Agrobacterium tumefaciens* or *Agrobacterium rhizogenes*. Whole plants are regenerated from the infected plant material using a suitable medium that contains antibiotics or biocides for the selection of transformed cells. Plants obtained in this way are then examined for the presence of the DNA introduced. The transformation of dicotyledonous plants via Ti-plasmid-vector systems and *Agrobacterium tumefaciens* is well established.

Monocotyledonous plants are also transformed by means of *Agrobacterium* based vectors (See Chan et al., Plant Mol. Biol. 22 (1993), 491-506; Hiei et al., Plant J. 6 (1994), 271-282; Deng et al., Science in China 33 (1990), 28-34; Wilmink et al., Plant Cell Reports 11 (1992), 76-80; May et al., Bio/Technology 13 (1995), 486-492; Conner and Domisse; Int. J. Plant Sci. 153 (1992), 550-555; Ritchie et al., Transgenic Res. 2 (1993), 252-265). Maize transformation in particular is described in the literature (see, for example, WO95/06128, EP 0 513 849; EP 0 465 875; Fromm et al., Biotechnology 8 (1990), 833-844; Gordon-Kamm et al., Plant Cell 2 (1990), 603-618; Koziel et al., Biotechnology 11 (1993), 194-200). In EP 292 435 and in Shillito et al. (1989, Bio/Technology 7, 581) fertile plants are obtained from a mucus-free, soft (friable) maize callus. Prioli and Sondahl (1989, Bio/Technology 7, 589) also report regenerating fertile plants from maize protoplasts of the maize Cateto inbred line, Cat 100-1.

Other cereal species have also been successfully transformed, such as barley (Wan and Lemaux, see above; Ritala et al., see above) and wheat (Nehra et al., 1994, Plant J. 5, 285-297).

Alternatives to *Agrobacterium* transformation for monocotyledonous plants are ballistics, protoplast fusion, electroporation of partially permeabilized cells and use of glass fibers (See Wan and Lemaux, Plant Physiol. 104 (1994), 37-48; Vasil et al., Bio/Technology 11 (1993), 1553-1558; Ritala et al., Plant Mol. Biol. 24 (1994), 317-325; Spencer et al., Theor. Appl. Genet. 79 (1990), 625-631)).

Introduced DNA is usually stable after integration into the plant genome and is transmitted to the progeny of the transformed cell or plant. Generally the transformed plant cell contains a selectable marker that makes the transformed cells resistant to a biocide or an antibiotic such as kanamycin, G 418, bleomycin, hygromycin, phosphinotricin or others. Therefore, the individually chosen marker should allow the selection of transformed cells from cells lacking the introduced DNA.

The transformed cells grow within the plant in the usual way (McCormick et al., 1986, Plant Cell Reports 5, 81-84) and the resulting plants are cultured normally. Transformed plant cells obtained by any of the above transformation techniques are cultured to regenerate a whole plant that possesses the transformed genotype and thus the desired phenotype. Such regeneration techniques rely on manipulation of certain phytohormones in a tissue culture growth medium, typically relying on a biocide and/or herbicide marker that has been introduced together with the desired nucleotide sequences.

Plant regeneration from cultured protoplasts is described in Evans et al., *Protoplasts Isolation and Culture* in "Handbook of Plant Cell Culture," pp. 124-176, MacMillan Publishing Company, New York, 1983; and Binding, *Regeneration of Plants, Plant Protoplasts*, pp. 21-73, CRC Press, Boca Raton, 1988. Regeneration also occurs from plant callus, explants, organs, or parts thereof. Such regeneration techniques are described generally in Klee et al. *Ann. Rev. of Plant Phys.* 38:467 (1987). Regeneration of monocots (rice) is described by Hosoyama et al. (*Biosci. Biotechnol. Biochem.* 58:1500 (1994)) and by Ghosh et al. (*J. Biotechnol.* 32:1 (1994)).

Seeds are obtained from the plants and used for testing stability and inheritance. Generally, two or more generations are cultivated to ensure that the phenotypic feature is stably maintained and transmitted.

One of skill will recognize that after the expression cassette is stably incorporated in transgenic plants and confirmed to be operable, it can be introduced into other plants by sexual crossing. Any of a number of standard breeding techniques can be used, depending upon the species to be crossed.

The nucleic acids of the invention are used to confer the trait of increased nitrogen use efficiency, without reduction in fertility, on essentially any plant.

The nucleotide sequences according to the invention generally encode an appropriate proteins from any organism, in particular from plants, fungi, bacteria or animals. The sequences preferably encode proteins from plants or fungi. Preferably, the plants are higher plants, in particular starch or oil storing useful plants, such as potato or cereals such as rice, maize, wheat, barley, rye, triticale, oat, millet, etc., as well as spinach, tobacco, sugar beet, soya, cotton etc.

In principle, the process according to the invention can be applied to any plant. Therefore, monocotyledonous as well as dicotyledonous plant species are particularly suitable. The process is preferably used with plants that are interesting for agriculture, horticulture and/or forestry. Examples are vegetable plants such as cucumber, melon, pumpkin, eggplant, zucchini, tomato, spinach, cabbage species, peas, beans, etc., as well as fruits such as pears, apples, etc.

Thus, the invention has use over a broad range of plants, including species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannesetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and, *Zea.*

5. Use of the Genes to Generate Transgenic Plants 4.2. Transformation of Plants and Plant Cells According to the present invention, a desirable plant may be obtained by transforming a plant cell with the nucleic acid constructs described herein. In some instances, it may be desirable to engineer a plant or plant cell with several different gene constructs. Such engineering nay be accomplished by transforming a plant or plant cell with all of the desired gene constructs simultaneously. Alternatively, the engineering may be carried out sequentially. That is, transforming with one gene construct, obtaining the desired transformant after selection and screening, transforming the transformant with a second gene construct, and so on. In preferred embodiments each gene constructs would be linked to a different selectable or screenable marker gene so as to facilitate the identification of plant transformants containing multiple gene inserts. In another embodiment, several different genes may be incorporated into one plant by crossing parental lines engineered for each gene.

In an embodiment of the present invention, *Agrobacterium* is employed to introduce the gene constructs into plants. Such transformations preferably use binary *Agrobacterium* T-DNA vectors (Bevan, 1984, Nuc. Acid Res. 12:8711-8721), and the co-cultivation procedure (Horsch et al., 1985, Science 227:1229-1231). Generally, the *Agrobacterium* transformation system is used to engineer dicotyledonous plants (Bevan et al., 1982, Ann. Rev. Genet. 16:357-384; Rogers et al., 1986, Methods Enzymol. 118:627-641). The *Agrobacterium* transformation system may also be used to transform as well as transfer DNA to monocotyledonous plants and plant cells. (see Hernalsteen et al., 1984, EMBO J. 3:3039-3041; Hooykass-Van Slogteren et al., 1984, Nature 311:763-764; Grimsley et al., 1987, Nature 325:1677-179; Boulton et al., 1989, Plant Mol. Biol. 12:31-40.; Gould et al., 1991, Plant Physiol. 95:426-434).

In other embodiments, various alternative methods for introducing recombinant nucleic acid constructs into plants and plant cells may also be utilized. These other methods are particularly useful where the target is a monocotyledonous plant or plant cell. Alternative gene transfer and transformation methods include, but are not limited to, protoplast transformation through calcium-, polyethylene glycol (PEG)- or electroporation-mediated uptake of naked DNA (see Paszkowski et al., 1984, EMBO J. 3:2717-2722, Potrykus et al. 1985, Molec. Gen. Genet. 199:169-177; Fromm et al., 1985, Proc. Nat. Acad. Sci. USA 82:5824-5828; Shimamoto, 1989, Nature 338:274-276) and electroporation of plant tissues (D'Halluin et al., 1992, Plant Cell 4:1495-1505). Additional methods for plant cell transformation include microinjection, silicon carbide mediated DNA uptake (Kaeppler et al., 1990, Plant Cell Reporter 9:415-418), and microprojectile bombardment (see Klein et al., 1988, Proc. Nat. Acad. Sci. USA 85:4305-4309; Gordon-Kamm et al., 1990, Plant Cell 2:603-618).

According to the present invention, a wide variety of plants and plant cell systems may be engineered for the desired physiological and agronomic characteristics described herein using the nucleic acid constructs of the instant invention and the various transformation methods mentioned above. In preferred embodiments, target plants and plant cells for engineering include, but are not limited to, those of maize, wheat, rice, soybean, tomato, tobacco, carrots, potato, sugar beets, sunflower, yam, *Arabidopsis*, rape seed, and petunia.

4.3. Selection and Identification of Transformed Plants and Plant Cells

According to the present invention, desired plants may be obtained by engineering the disclosed gene constructs into a variety of plant cell types, including but not limited to, protoplasts, tissue culture cells, tissue and organ explants, pollens, embryos as well as whole plants. In an embodiment of the present invention, the engineered plant material is selected or screened for transformants (those that have incorporated or integrated the introduced gene construct(s)) following the approaches and methods described below. An isolated transformant may then be regenerated into a plant. Alternatively, the engineered plant material may be regenerated into a plant or plantlet before subjecting the derived plant or plantlet to selection or screening for the marker gene traits. Procedures for regenerating plants from plant cells, tissues or organs, either before or after selecting or screening for marker gene(s), are well known to those skilled in the art.

A transformed plant cell, callus, tissue or plant may be identified and isolated by selecting or screening the engineered plant material for traits encoded by the marker genes present on the transforming DNA. For instance, selection may be performed by growing the engineered plant material on media containing inhibitory amount of the antibiotic or herbicide to which the transforming gene construct confers resistance. Further, transformed plants and plant cells may also be identified by screening for the activities of any visible marker genes (e.g., the .beta.-glucuronidase, luciferase, B or C1 genes) that may be present on the recombinant nucleic acid constructs of the present invention. Such selection and screening methodologies are well known to those skilled in the art.

Physical and biochemical methods also may be also to identify plant or plant cell transformants containing the gene constructs of the present invention. These methods include but are not limited to: 1) Southern analysis or PCR amplification for detecting and determining the structure of the recombinant DNA insert; 2) Northern blot, Si RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct; 4) protein gel electrophoresis, Western blot techniques, immunoprecipitation, or enzyme-linked immunoassays, where the gene construct products are proteins. Additional techniques, such as in situ hybridization, enzyme staining, and immunostaining, also may be used to

4.4. Screening of Transformed Plants for Those with Improved Agronomic Traits According to the present invention, to obtain plants with improved agronomic characteristics, the transformed plants may be screened for those exhibiting the desired physiological alteration. For example, where the plants have been engineered for ectopic overexpression of a GS enzyme, transformed plants are examined for those expressing the GS enzyme at the desired level and in the desired tissues and developmental stages. Where the plants have been engineered for suppression of a target gene, transformed plants are examined for those expressing the target gene product (e.g., RNA or protein) at reduced levels in various tissues. The plants exhibiting the desired. physiological changes, e.g., ectopic GS overexpression or GS suppression, may then be subsequently screened for those plants that have the desired agronomic changes.

Alternatively, the transformed plants may be directly screened for those exhibiting the desired agronomic changes. In one embodiment, such screening may be for productive growth of the transformed plants under nitrogen nutrient deficient conditions. That is screen for growth of transformed plants under conditions, with respect to the available nitrogen nutrient, that cause the growth of wild-type plant to cease or to be so diminished as to significantly reduce the size or quality of the wild-type plant. An example of a nitrogen nutrient deficient condition for tobacco and plants with similar nitrogen nutrient requirements is that where the sole nitrogen nutrient in the soil or synthetic medium is (a) nitrate supplied or periodically applied at a concentration of 0.5 mM or lower, or (b) physiological equivalents of nitrate (e.g., ammonium or a mix of nitrate and ammonium) supplied or periodically applied at a concentration that is physiologically equivalent to 0.5 mM nitrate or lower (see Eckes et al., 1988, Australian Patent Office document no. AU-A-17321/88). Another example of a nitrogen nutrient deficient condition is that where the steady state level of the available nitrogen nutrient in the soil or synthetic medium is less than about 0.02 mM nitrate or physiological equivalents thereof. The term nitrate as used herein means any one or any mix of the nitrate salts commonly used as plant nitrogen fertilizer, e.g., potassium nitrate, calcium nitrate, sodium nitrate, ammonium nitrate, etc. The term ammonium as used herein means any one or any mix of the ammonium salts commonly used as plant nitrogen fertilizer, e.g., ammonium nitrate, ammonium chloride, ammonium sulfate, etc.

In other embodiments, the screening of the transformed plants may be for improved agronomic characteristics (e.g., faster growth, greater vegetative or reproductive yields, or improved protein contents, etc.), as compared to unengineered progenitor plants, when cultivated under nitrogen non-limiting growth conditions (i.e., cultivated using soils or media containing or receiving sufficient amounts of nitrogen nutrients to sustain healthy plant growth). An example of nitrogen non-limiting conditions for tobacco and plants with similar nitrogen nutrient requirements is that where the sole nitrogen nutrient in soil or synthetic medium is (a) nitrate supplied or periodically applied at a concentration of 10 mM or higher, or (b) physiological equivalents of nitrate supplied or periodically applied at a concentration that is physiologically equivalent to 10 mM nitrate or higher. Another example of nitrogen non-limiting conditions is that where the steady state level of the available nitrogen nutrient in the soil or synthetic medium is at least about 1.0 mM potassium nitrate or physiological equivalents thereof. Additional guidance with respect to what are nitrogen nutrient deficient or "non-limiting" conditions for plant growth may be found in the art. See for example, Hewitt, E. J., Sand and Water Culture Methods Used in the Study of Plant Nutrition, 2nd ed., Farnham Royal (Bucks), Commonwealth Agricultural Bureaux, 1966; and Hewitt, E. J., Plant Mineral Nutrition, London, English University. Press, 1975.

In embodiments where the transformed plants are legumes, direct screenings for transformed plants with the desired agronomic changes and improvements may be conducted as described above but under conditions where nodule formation or nitrogen-fixation is suppressed.

According to the present invention, plants engineered with the alterations in nitrogen assimilation or utilization processes may exhibit improved nitrogen contents, altered amino acid or protein compositions, vigorous growth characteristics, increased vegetative yields or better seed yields and qualities. Engineered plants and plant lines possessing such improved agronomic characteristics may be identified by examining any of following parameters: 1) the rate of growth, measured in, terms of rate of increase in fresh or dry weight; 2) vegetative yield of the mature plant, in terms of fresh or dry weight; 3) the seed or fruit yield; 4) the seed or fruit weight; 5) the total nitrogen content of the plant; 6) the total nitrogen content of the fruit or seed; 7) the free amino acid content of the plant; 8) the free amino acid content of the fruit or seed; 9) the total protein content of the plant; and 10) the total protein content of the fruit or seed. The procedures and methods for examining these parameters are well known to those skilled in the art.

According to the present invention, a desired plant is one that exhibits improvement over the control plant (i.e., progenitor plant) in one or more of the aforementioned parameters. In an embodiment, a desired plant is one that shows at least 5% increase over the control plant in at least one parameter. In a preferred embodiment, a desired plant is one that shows at least 20% increase over the control plant in at least one parameter. Most preferred is a plant that shows at least 50% increase in at least one parameter.

5. Assays for Determining Nitrogen Use Efficiency Characteristics

The nucleotide sequences of the invention were assayed for nitrogen use efficiency by means of several assays.

5.1 Nitrogen Assimilation Inhibitor (MSX) Screen

Seeds from $T_1$, $T_2$ and/or $T_3$ lines containing the gene of interest are plated on MS media containing MSX (0.1 mM). Wild type WS and transgenic (750 vector) control seeds were similarly plated. Plates were evaluated at nine days post-planting. The greener plants were transferred to MS media to recover for one week and then transferred to solid for attention of selfed seeds and testing in the $T_3$ generation.

Basta™ resistance was assigned in the $T_2$ and $T_3$ generations.

Purpose: Methionine sulfoximine inhibits GS/GOGAT, affecting biosynthesis of major nitrogen containing compounds (amino acids, nucleotide, chlorophyll, polyamine and alkaloid biosynthesis). The benefit of this screen is that it will find over-expressors that have improved nitrogen uptake and/or utilization independent of available nitrogen in the soil.

Procedure:
1. Sterilization of Seeds.

Aliquot 1200 seeds for T2 or 1700 seeds for T3 into 1.5 mL eppendorf tube.

Pipette 1.5 mL 30% bleach solution into tube (15 mL of industrial strength Clorox bleach and add water to 50 mL). Incubate seeds in bleach solution for 5 minutes, inverting tube periodically. Spin in Eppendorf centrifuge until maximum speed is obtained (approximately 14-15K) and stop. Remove bleach solution using a fresh P1000 pipette tip.

Pipette 1.5 mL of sterile water into tube. Invert tube to suspend seeds (2×). Spin tube in eppendorf centrifuge until maximum speed is obtained. Remove water using a fresh P1000 pipette tip, avoid sucking up seeds. It is okay if some water is left behind. Repeat this step 2 more times.

Pipette 1 ml, of sterile 0.2% phytagar into tube.

Cover tubes with aluminum foil and stratify in 4° C. refrigerator for 3 days.

2. Prepare 100 mM Filter Sterilized Methionine Sulfoximine.

Dissolve 27.03 mg of methionine sulfoximine in 1.5 mL of water. Use 1.3 mL of water to dissolve and then add water to 1.5 mL.

Filter sterilize using 0.20 mm Super Membrane non-pyrogenic filter.

3. Make 1 L of MS media.

| (per liter) | Amount Added |
|---|---|
| MS media | 4.3 g |
| MES hydrate | 0.5 g |
| Sucrose (0.5%) | 5 g |
| Methionine Sulfoximine (100 mM) (after autoclaving) | 1000 μl |

Fill a 2 L Nalgene bucket with 900 mL of water. Place magnetic stir bar into bucket and place on stir plate and begin stirring water.

Dissolve 4.3 g of MS media, 0.5 g MES hydrate, and 5 g sucrose in water. Stir until all components have dissolved.

Pour media into 1 L graduated cylinder and add water to 1 L. Return media to 2 L Nalgene bucket and allow to stir for a few minutes.

Use 10N KOH solution to pH media to 5.7.

Pour media into 2 L Pyrex bottle. Add 10 g of Microbiology Agar-Agar granulated to bottle. Place a magnetic stir bar in the bottle.

Autoclave the media under the following conditions: 35 min sterilization time at 121° C.

When media is finished autoclaving, remove the media from the autoclave and allow it to cool in 55° C. water bath for approximately one hour.

Set up square plates in Laminar flow hood and label plates.

When media has cooled to approximately 55° C., place on stir plate until agar is well mixed into media.

Add 1000 μl of 100 mM filter sterilized methionine sulfoximine. Swirl to mix. Use a 50 mL disposable pipette to pipette 45 mL of media into the plates.

Allow to solidify in Laminar flow hood over night, but make sure that the hood is turned off in the evening to ensure that the media doesn't dry out.

4. Plate Seeds.

Remove 1.5 mL eppendorf tube containing approximately 1200 seeds from 4° C. and unwrap foil covering.

Using a P1000, pipette entire contents of eppendorf tube onto plate, placing small drops of liquid evenly around plate.

Using tip of spreader, spread the seeds evenly across plate.

Place in 22° C. growth chamber.

5. Evaluation of Plants Exhibiting Positive Stress Response.

Evaluate plates at 9 days post plating.

Transfer plants exhibiting a positive stress response (i.e. green) to MS media plates for recovery.

After one week of recovery, extract DNA from leaf sample and PCR amplify according to Ceres Protocol-HTP plant QC steps 2-13.

Transplant plants to soil for T3 seed.

Test T3 seeds as above.

5.2. Chlorophyll Assessment

Chlorophyll Measurements from *Arabidopsis* Shoots

Primary references: Moran and Porath (1980) Chlorophyll determination in intact tissues using N,N-dimethylformamide. Plant Physiol. 65:478-479.

Moran (1982) Formulae for determination of chlorophyllous pigments extracted with N,N-dimethylformamide. Plant Physiol. 69: 1376-1381.

For *Arabidopsis* grown on plates, shoots or whole plants can be used. (It is almost always very difficult to recover roots from the agar without agar attached, and the roots often break. Limiting tissue collection to shoot tissue, if mass is sufficient, is highly advised).

Individual plants or plant tissues are removed from the plate with a fine scissors and placed on a balance that is capable of measuring single milligram masses. Plant material is immersed in a 10% (w/v) solution of N,N-dimethylformamide according to the mass of the plant (e.g., 5.0 mg of tissue is immersed in 500 ul of N,N-DMF).

OR use 200 ul tips using the "other tip" to punch consistent size hole (for At)

Punch leaf weight=~0.0043 (0.0258/6) or 4.3 mg radius=2.5 mm

Circumference=15.7 mm

Area=19.625 mm immersed in 400 ul of N,N-DMF puncher (for corn)

leaf weight=~~0.0032 (0.0228/7) or 3.2 mg radius=4 mm

Circumference=25.12 mm

Area=50.24 mm immersed in 300 ul of N,N-DMF

The samples are kept in the dark at 4 degrees C. overnight. According to references the chlorophyll in the samples remains quite stable in this state over a matter of days. Before measuring, spin the samples for 5 minutes at maximum speed in a microfuge to pack down the tissue and facilitate removal of the N,N-DMF sample for spectrophotometry.

Remove 100 ul of sample and place in a micro-cuvette in the spectrophotometer. Read the $OD_{664}$ and the $OD_{647}$ of each sample. There is a protocol on the Lab3 spec called "Ed_CHL." The amount of chlorophyll A, chlorophyll B, and total chlorophyll is calculated with the following formula:

$C_t = C_a + C_b$, where $C_t$=total chl, $C_a$=chl A, and $C_b$=chl B.

$C_t = 7.04\, A_{664} + 20.27\, A_{647}$ $C_a = 12.64 A_{664} - 2.99 A_{647}$ $C_b = 5.6 A_{664} + 23.26 A_{647}$ 5.3. Nitrogen Assay in Soil Purpose:

To confirm MSX lead candidates by quantitative assays under 3 different nitrogen soil conditions.

Procedure:

1. Stratifying seeds (day one).

Aliquot the number of seeds that you will need into 15 ml corning tube.

Since you will be sowing approximately five seeds per pot, you will need about 540 seeds for each transgenic event and approximately 540 seeds for wild-type segregant seed. For WS and Col you will need about half (270) the amount of seed.

Add 10 ml of 0.2% agar-agar solution to each tube. Suspend seeds by tapping tube upside down for several times Place tubes in 4° C. in the dark for 4 days to stratify. This will insure uniform germination.

2. A. Prepare soil (day three).

Prepare 36 flats of 3:2 soil dilution for each line to be tested. Nine flats will be used for one treatment (or 1 N concentration). The cement mixer can hold soil mix enough for 9 flats.

In cement mixer, mix 3 parts Metromix 200 with 2 parts Thermorock vermiculite. For 9 flats, this is about 54 L of Metromix 200 and 36 L of Thermorock vermiculite.

To keep the soil consistent for the experiment it is better to make extra soil than to make two batches. And take soil from the same stock every time.

Throw out excess soil.

B. Fill 24-pacs flats with soil.

Fill 36 empty 24-pacs heaping over the rim with prepared soil.

Level the soil with a straight edge.

Place the filled pot into a no-hole utility flat.

3. Saturate the soil (day four).

Put 3 L of water/per flat into the no-hole utility flat.

Allow to saturate over a few hours. Do not pour off excess liquid.

4. Sow the seeds (day four).

Each flat will contain 6 pots of one event, 6 pots of the second event, and 6 pots each of wild-type segregant control seeds (2 events and 2 wild-type segregant=24 pots=1 flat). There are usually 2 events for each MSX lead candidate to be tested.

Place a single flat on the bench.

Break off 5/8"×5" Styrene labeling tags and place in one per pot.

The tags will only contain the unique plant number information and the nitrogen condition.

You will need to bring a excel sheet that tells you which seed lines go with which pot in the specified nitrogen condition.

Choose the corresponding seed that matches the labeled pot/flat.

Pipette out the 0.2% agar containing 5 seeds into the 6 pots randomly placed in the flat (note the pipette can be reused for each seed type, but must not be cross-contaminated). Placing 5 seeds into each pot ensures that each pot will have a surviving plant.

Repeat planting steps across all nitrogen conditions.

Cover each flat with a propagation dome when finished. Secure the lid down.

Place flats in the greenhouse (16 hour photoperiod).

5. Remove propagation dome.

One week after sowing, remove propagation dome.

Add about 1 L of water the next day to each of the flats.

6. Weed out excess seedlings. In this experiment, the wild-type segragant plants will also be used as internal controls for quantitative analysis. Therefore the spraying of finale will NOT be used.

Using forceps, carefully weed out excess seedlings such that only one plant per pot remains throughout the flat.

This is usually done when at least one of the plants looks like it will survive (i.e. true leaves are just starting to form).

7. Recommended watering schedule. Watering is done twice (Tue and Fri) in a week which starts on the $2^{nd}$ week of planting.

Nitrogen treatment is done during the $2^{nd}$ week of planting when plants are fully established.

Prepare ¼× Hoagland's (no nitrogen) solution from 2× stock (2.5 L of the 2× Hoagland's diluted to 20 L with water).

Add the amount of nitrogen required to get 25, 250 and 1500 ppm of $NO_3$ as sole nitrogen source. See sample calculations below

| Nitrogen source KNO3 ppm | Stock (mM) 2000 mM | vol. Req (ml) | total vol. (li) |
|---|---|---|---|
| 25 | 1.78 | 17.8 | 20 |
| 250 | 17.8 | 178 | 20 |
| 750 | 53.4 | 534 | 20 |
| 100 (REF VALUE) | 7.12 | | | used KNO3 only for this experiment

Water the corresponding flats with 2 L of the required nitrogen concentration. Done once during the $2^{nd}$ week.

On the $3^{rd}$ week, (exactly 1 week apart) one more watering with 750 ppm (53.4 mM) concentration is done and the rest of the flats will be watered with ¼× Hoagland's (no nitrogen) solution ONLY.

Use water only during other times in the schedule until completion of experiment Note—This schedule may vary depending on the soil humidity in the greenhouse during the run of the experiment.

8. Capture quantitative measurements.

Make note of any unexpected qualitative phenotypes (i.e. delayed in bolting, stunted growth and/or any sign of stress etc).

At bolting (when about 80% of the plants in the flat have bolted).

Measure length and width of rosette to get rosette area and average diameter.

10. Take Biomass. Taken 7 days later.

Take all the plant aerial part by cutting at the base of the plant under the rosette leaves and put in the labeled envelopes.

Place the envelopes in drying oven for 1-2 days.

Remove plants from oven and allow to cool down for a couple of hours.

Weigh plants on scale.

5.4. High pH Assay

This assay provides a tool to screen for plants that are better able to thrive and or recover under the nutritional limitations imposed by high pH conditions. Plants transformed with the gene of interest are evaluated for greenness and size on high pH media. The seeds are sterilized and plated on high pH media (pH 9.0). The pH is adjusted to 8.5 instead of 9.0 for individual event assays. In assaying individual events where only 36 seeds are plated (instead of ±1700 seeds as for superpools, a lower pH of 8.5 is needed to assess growth more thoroughly. Plates are evaluated at 7 and 12 days post-plating. Wild-type Wassilewskija (Ws) control seed are sterilized and stratified in parallel to ME00175-01, -02, and -03.

Purpose:

To screen for mutants better able to thrive under nutritional deficiencies (Phosphate, Manganese, Iron, Boron) imposed by alkaline conditions.

Procedure:

1. Seed Pooling.

MASTER POOL: Approximately, 200 seeds for each of 5 independent cDNA's were pooled together into one tube. This was referred to as a "Master Pool". Care was taken to make sure that approximately the same numbers of seeds were taken from each of the five lines.

SUPER POOL: Approximately 200 seeds from 500 "Master Pools" were pooled together into one tube. This was referred to as a "Super Pool". Care was taken once again to make sure that the same number of seeds were taken from each of the "Master Pools".

2. Seed Sterilization.

Aliquot 50 seeds from each MasterPool into 1.5 mL tubes for sterilization.

Aliquot 1200 of pooled seeds from each SuperPool into a 2 mL tube for sterilization Add 600 ul of fresh 50% bleach solution. Invert tube to suspend seeds. Shake for 5 minutes by inverting tubes in plastic microtube racks. Allow seeds to settle and remove bleach solution.

Apply 600 μl of sterile distilled water. Invert tube to suspend seeds (2×). Allow seeds to settle and remove water with a pipet. Repeat 3 times. After last wash, re-suspend seeds in 500 μl of sterile distilled water. Invert to suspend seeds.

Stratify at 4° C. for 3 days.

3. Preparation of High pH Assay Media (per liter).

Prepare MS+0.5% Sucrose (S0389, Sigma), 0.5 g/L MES hydrate (M8250, Sigma) and 7.0 g/L agar-agar. pH was adjusted with 10 N KOH.

Initial tests were performed on a range of pH values: pH 5.7 (CONTROL), pH 7.03, pH 8.02, pH 9.01, pH 10.18

Sterilize for 20 minutes at 122° C.

Pour 45 mL of media per size square plate. Make sure to swirl the media each time it is poured to make sure that precipitation that results as a result of pH adjustments is homogenously distributed throughout all plates and homogenously distributed within a plate.

Re-pH cool autoclaved media to verify final pH in culture. This is done by making a slurry of the solidified media with a spatula.

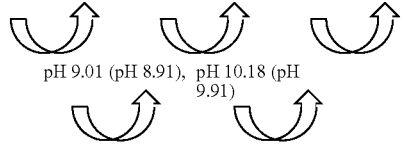

Initial Results demonstrated the pH values decreased after autoclaving as illustrated above. Consequently pH in media needs to be verified after autoclaving for all experiments. Analysis of results have demonstrated that pH 9.01 (pH 8.91) is most efficient for a high pH assay allowing for germination but no growth beyond 2 to 5 mm. At pH 9 there was also no root growth observed. Higher pH, results in no germination (pH 10.18). Our goal is to see a great difference in the vigor and greenness between wild type (WS), non-resistant pools and those of putative resistant pools. Consequently pH 9.0 will be used to screen all Master Pools and pH 9.5 will be used to screen all Super pools. A higher pH will be used to screen all Super Pools because the higher seed density per plate causes a rapid shift in the pH within the plate only 2 days after sowing seeds. Consequently a higher initial pH is needed to achieve the same screening result used in the Master Pool pH 9.0 screens.

4. Plate Seed.

MASTER POOLS: Plate 12 seeds (from Master Pooled lines in a straight line across two MS pH 9.0 plates (24 seedlings) and 2 MS pH 5.7 (CONTROL MEDIA) plates oriented in a vertical position. Seedlings plated on MS pH 5.7 were used as a control visual screen for shoot and root growth. 10 plates of WS wild type as controls were plated on MS pH 9.0 to make sure that there were no escapes in each of the experiments.

SUPER POOLS: Plate 1200 seeds on large 22.5×22.5 cm square plates. Approximately 100 seeds of WS wild type and Transgenic WS (35S-YFP Vector) were included within the same plate to insure pH shifts within the plate conform to the described screen.

Wrap plates with porous Micropore tape and stack vertically on a shelf (Master Pools only). Super Pool plates are oriented horizontally.

Place plates in 22° C. walk-in growth chamber. Light measurements in LUX units were taken to insure that all plate stacks were receiving sufficient light.

5. Scoring Each Plate.

After 7 and 14-days score both root and shoot growth on visual (MS pH 5.7) and high pH screens (MS pH 9.0)

High pH in soil or media (Normal soil pH 6.0 to 6.5) does not allow plants to absorb sufficient iron, Boron and Manganese. Iron is a component of chlorophyll thus the resultant plants lack green color and do not thrive. In this assay we are looking for seedlings that are able to overcome this deficiency.

5.5 Soil Performance Assay II

A second soil assay was initiated to test the effect of a broader range of nitrogen concentrations on the leads. A true wild type segregant of event ME03118-01 was obtained and used in this experiment. This experiment was carried in two greenhouse environments, one in Thousand Oaks, Calif. and the second in Malibu, Calif. The modified experiment design is described in methods and materials section "Soil-Nitrate Performance Assay II". The main differences to the previous soil assay were the use of nitrate as the sole source of N, and the use of a wider range of nitrate concentrations, ranging from 25 to 1500 ppm nitrate. A line segregating for a UDP-Glucose epimerase transgene was included as a control for comparison.

The results from the Thousand Oaks greenhouse experiment indicate that ME3118-04 consistently shows a trend for better performance on medium and high N concentration in at least 2 replicates for biomass and 3 reps in rosette area. The improvement in biomass are statistically significance at P<0.05 in one of the 1500 ppm reps, and is also significant when all replicate data is pooled. The second event for ME3118, ME3118-01, did not show improved performance relative to its wild type segregant control. In addition, ME3228 lines did not show improved performance on any nitrogen concentration.

The Malibu greenhouse experiment showed somewhat similar results to the Thousand Oaks experiment. Again, ME3118-04 consistently shows better performance than its control on all of three N concentrations in all replicates for biomass and rosette area. However, the improvement in biomass and rosette area is less pronounced than in the Thousand Oaks greenhouse experiment and are not statistically significant at the P<0.05 level in any condition or measurement. The control transgenic line misexpressing the UDP-glucose epimerase gene did not show any significant improvements in rosette area or biomass production in either greenhouse experiment.

Overall the results indicate that ME3118 can impart beneficial nitrogen use characteristics on transgenic *Arabidopsis* but the improvements may be significantly influenced by the environmental conditions the plants are grown under. Another factor is the genetic background of the germplasm. A striking difference is observed between the Columbia and WS ecotypes in terms of their rosette area and biomass accumulation as a function of nitrogen supplied Columbia continues to positively respond to added nitrogen up to 1500 ppm whereas WS becomes slightly inhibited in growth at 1500 ppm. This indicates that it will be important to examine Lead 32 in other genetic backgrounds.

RESULTS

The results from the assays are set forth in the individual sections of Table I, namely Table I-A J. The results evidence the activity of the nucleotides of the invention, and their usefulness for making genetically engineered plants having improved nitrogen use efficiency characteristics. Such genetically engineered plants can be made by using one of the sequences described in Table I, as well as one or more of the orthologs thereof described in Table II.

The invention being thus described, it will be apparent to one of ordinary skill in the art that various modifications of the materials and methods for practicing the invention can be made. Such modifications are to be considered within the scope of the invention as defined by the following claims.

Each of the references from the patent and periodical literature cited herein is hereby expressly incorporated in its entirety by such citation.

Lengthy table referenced here

US07696409-20100413-T00001

Please refer to the end of the specification for access instructions.

Lengthy table referenced here

US07696409-20100413-T00002

Please refer to the end of the specification for access instructions.

Lengthy table referenced here

US07696409-20100413-T00003

Please refer to the end of the specification for access instructions.

Lengthy table referenced here

US07696409-20100413-T00004

Please refer to the end of the specification for access instructions.

Lengthy table referenced here

US07696409-20100413-T00005

Please refer to the end of the specification for access instructions.

Lengthy table referenced here

US07696409-20100413-T00006

Please refer to the end of the specification for access instructions.

Lengthy table referenced here

US07696409-20100413-T00007

Please refer to the end of the specification for access instructions.

Lengthy table referenced here

US07696409-20100413-T00008

Please refer to the end of the specification for access instructions.

Lengthy table referenced here

US07696409-20100413-T00009

Please refer to the end of the specification for access instructions.

Lengthy table referenced here

US07696409-20100413-T00010

Please refer to the end of the specification for access instructions.

Lengthy table referenced here

US07696409-20100413-T00011

Please refer to the end of the specification for access instructions.

Lengthy table referenced here

US07696409-20100413-T00012

Please refer to the end of the specification for access instructions.

Lengthy table referenced here

US07696409-20100413-T00013

Please refer to the end of the specification for access instructions.

Lengthy table referenced here

US07696409-20100413-T00014

Please refer to the end of the specification for access instructions.

Lengthy table referenced here

US07696409-20100413-T00015

Please refer to the end of the specification for access instructions.

Lengthy table referenced here

US07696409-20100413-T00016

Please refer to the end of the specification for access instructions.

Lengthy table referenced here

US07696409-20100413-T00017

Please refer to the end of the specification for access instructions.

Lengthy table referenced here

US07696409-20100413-T00018

Please refer to the end of the specification for access instructions.

Lengthy table referenced here

US07696409-20100413-T00019

Please refer to the end of the specification for access instructions.

Lengthy table referenced here

US07696409-20100413-T00020

Please refer to the end of the specification for access instructions.

REFERENCES

Masucci J D and Schiefelbein J W. (1996) Hormones act downstream of TTG and GL2 to promote root hair outgrowth during epidermis development in the *Arabidopsis* root. Plant Cell 8: 1505-1517.

Nagpal P, Walker L M, Young J C, Asonawalda A, Timpte C, Estelle M, and Reed J W. (2000) AXR2 encodes a member of the Aux/IAA protein family. Plant Physiology 123: 563-573.

Schachtman D P, Reid R J, and Ayling S M. (1998) Phosphorus uptake by plants: from soil to cell. Plant Physiology 116: 447-453.

Mori S. (1999) Iron acquisition by plants. Cliff Opin Plant Biol 2: 250-253. Raghothama K G. (1999) Phosphate acquisition. Annu Rev Plant Physiol Plant Mol Biol 50: 665-693.

Schmidt W. (1999) Mechanisms and regulation of reduction-based iron uptake in plants. New Phytology 141: 1-26.

Bonser A M, Lynch J, and Snapp S. (1996) Effect of phosphorus deficiency on growth angle of basal roots of Phaseolusu vulgaris L. New Phytology 132: 281-288.

Romera F J, Alcantara E, and de la Guardia M D. (1999) Ethylene production by Fe-deficient roots and its involvement in the regulation of Fe-deficiency stress responses by strategy I plants. Ann Bot 83: 51-55.

Landsberg E C. (1981) Fe stress induced transfer cell formation: regulated by auxin? Plant Physiology 67: S-100.

Schmidt W, Tittel J, and Schikora A. (2000) Role of hormones in the induction of Fe deficiency responses in *Arabidopsis* roots. Plant Physiology 122: 1109-1118.

Schimidt W and Schikora A. (2001) Different pathways are involved in phosphate and iron stress induced alterations of root epidermal cell development Plant Physiol, April 2001, Vol. 125, pp. 2078-2084.

Friml J. (2003) Auxin transport: shaping the plant. Curr Opin Plant Biol 6: 7-12.

Rawat S, Silim S, Kronzucker H, Siddiqi M, and Glass A (1999) AtAMT1 expression and NH4+ uptake in roots of *Arabidopsis thaliana*:evidence for regulation by root glutamine levels. Plant Journal 19:143-152.

LENGTHY TABLES

The patent contains a lengthy table section. A copy of the table is available in electronic form from the USPTO web site (http://seqdata.uspto.gov/?pageRequest=docDetail&DocID=US07696409B2). An electronic copy of the table will also be available from the USPTO upon request and payment of the fee set forth in 37 CFR 1.19(b)(3).

SEQUENCE LISTING (219 sequences)

SEQ ID NO: 1 - DNA, 1654 bp, Arabidopsis thaliana
  misc_feature (1)..(496): Sequence obtained in planta using Ceres clone 15650 and Ceres cDNA 12422368
  CDS (45)..(1535)
attatagaatatctaataatgaagaatcggtttcaaaattaataatgactgattataattacattgacaacatgcagggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacgcagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcacgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaattctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttccaagaaatcgatggaatgatttaatagactatccttagggacaacaagaagattgtcgatgttgtttgaataattactatgacaatgtatgtatcataatatgtaagaactagaatatataataaatttttaccttcc

SEQ ID NO: 2 - protein, 496 aa, Arabidopsis thaliana
MTDYNYIDNMQGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFTIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSME

SEQ ID NO: 3 - DNA, 519 bp, Arabidopsis thaliana
  misc_feature (1)..(519): Ceres cloen 121073 and Ceres cDNA ID 12578718
  CDS (50)..(301)
aacaactttaaatctttaatagaaaaaaaataagcaactaacaaaaaaaatggaggccgagaaaacaccaccgacgacgacaacaacgacggagaagaaaacggagcaagtgaaagacaacgacttgccgaccgatagcccttacatggctacgggtactttggaagattacaaattgaaagcttatggagccgaaggtcaccaagagcctactcctggtcttggaggtggctccaccgatgctcctactccttctggcgacgcacccgccgccactaccaccgatgcgaaagctccgtgaaaaaaagaaagactataataatgaacaggttttgtggatcgtcggaaaacaaacccataattgtagtatgttcaataactgatccagcttcgtttcttaacgtttttatggtttaattaaaaatgtatttgcgtctaatgctgaatgctaaagttcgagtttcgtatcaaatgaagttgtaacgatttaataattaatgtgaagcttatttctttttg

SEQ ID NO: 4 - protein, 83 aa, Arabidopsis thaliana
MEAEKTPPTTTTTTEKKTEQVKDNDLPTDSPYMATGTLEDYKLKAYGAEGHQEPTPGLGGGSTDAPTPSGDAPAATTTDAKAP

SEQ ID NO: 5 - DNA, 989 bp, Arabidopsis thaliana
  misc_feature (1)..(989): Ceres clone 6288 and Ceres cDNA ID 12335951
  CDS (95)..(802)
tccctgaagaaaattgaaaggagcttaataaacagaagccgttctccttcactttcgttcctctcacttccatacaacatttgaaacctcagctatgcctaaatcaaagcgagatagaccagtgactttgtctaagacgaagaagaaaggaagagagcataaggagtgtattgtgaatggaattagggaggctgttgaaaaatattcctctgtctatgttttctcttttgaaaacatgagaaatatcaaattcaaggagtttaggcagcagtttaggcacaatggaaagttcttcctaggttcgaacaaagtgatgcaggttgctcttggtcgttctgcagaagatgaactccgttctggtatctacaaagtctccaagctgcttcgtggtgatactggacttcttgttactgatatgccaaaggaagaagtcgaaagcttatttaacgcttatgaggattccgacttttcaaggaccggaagcattgcagtagaaacggttgaactgaaggaaggtcctctagaacagttcacacatgagatggaaccacttcttcggaagcttgaaatgcctgtacgactaaacaaaggtactgtggagttggtcgctgactttgtagtttgtgaagaaggaaaacaactttcgccaaaatcagcccacattttgcgtctattgcgaatgaagatggctactttcaagctgaacttgctctgcagatggagccctagtgactttgagctttacagagaagatctgtcagagctttaccgagaagatctctcagacgttgaaacctcttaggaagccaagattttgactccaccctttaaatttttcttaatatcatcactatcacatggattttatattgtggcacatggtttgcattcaaatgttttaagtcaaagttttgcttgctttacatattttgtagaatatcaacttatcttcaagaaccccctatcctaatattggcaaatcaatcttg

SEQ ID NO: 6 - protein, 235 aa, Arabidopsis thaliana
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETVELKEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 7 - DNA, 1195 bp, Arabidopsis thaliana
  misc_feature (1)..(1195): Ceres clone 38286 and Ceres cDNA ID 13487831
  CDS (58)..(789)
cttcccctcttaccttttcagagagagaaacaatatttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgattgatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcaattggacttgctccgagagcaatggagaagtactgcaagaacagatcttgaattaataaaaaaaaaaagaagcatcaatgatcaacaatatgacgggttcttgattttttatgtatttttatgattgtatgtggctatcacctatatatgtgtgttgtaattttaaatacttgatgggtatatagggcagtattttaccagtaagatgtggacaaacttgtaatgtgaccaaaagagaggaaacttcaatatctctgtgtttgtgtcatatttattgcccaacatgtgtctgtcggtttgatgatcaatcacaacttgatatgtgcatacatataaatgtgtgtatgtaggtgtgtgtacatgtacatgtgttttgatccctactctgctacttgtcgtttcttgtgtgtgttatctaatagttttttcccaaaatgaataattcgttgttatgttt

SEQ ID NO: 8 - protein, 243 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 9 - DNA, 1638 bp, Arabidopsis thaliana
  CDS (1)..(1638): Ceres cDNA ID 2702830
atggcttccattgatgaagaaaggtcacttcttgaagttgaagaatctcttatacaggaagaagtaaaattatatgctgaagatggttcaatagatattcatggaaacccaccattgaagcagacaacaggaaactggaaagcttgtccattcatttttgcaaacgaatgctgcgaacggttggcttattatggaattgccaagaatctcatcacgtacttcacaaatgaattgcatgagactaatgtttctgctgctagacacgtcatgacatggcaaggaacatgttacatcactcctcttattggagctttaatagctgatgcttactggggaagatattggactattgcttgtttctctgccatttatttcaccggaatggttgcattgacactctcagcttcagttccgggtcttaagccagcggaatgcattggctctctatgtccaccagcaacaatggttcagtctacggttttattttcagggctttaccttatcgctcttggcactggaggaatcaaaccatgtgtctcatcctttggtgctgatcagtttgataagaccgatccaagcgaacgagtcagaaaagcttctttctttaactggttttacttcactatcaacattggtgcttttgtttcatctactgttctagtttggattcaagagaattatggatgggaattaggattcttgatacctaccgtgttcatgggacttgctactatgagtttcttctttggcacgccgctttatagatttcagaaaccgagaggtagcccgattactagcgtctgccaagttcttgtagccgcataccgtaaatcgaatctcaaggtccctgaagactccacggacgaaggagatgcaaacactaacccgtggaagctatgtaccgtgactcaagtcgaagaagttaagattctgttacgtttggtccccatttgggcctcaggaatcatcttctcagttctccattcacagatttacactctctttgttcaacaaggacggtgcatgaaacgaaccatcggcttattcgaaatccctcccgcaactctcgggatgttcgacactgcaagtgttctcatatctgtcccaatctatgaccgcgtcatcgttcccttagtgagacggttcacaggcttagctaaaggattcaccgagctacaaagaatggggattggtctttttgtctctgttttgagcttgacatttgcagctatcgttgagacggttcggttacagttagctagagatcttgatctagtggaaagtggagacattgttccattaaacatcttttggcaaatccctcagtactttttaatgggcactgctggagttttcttctttgttgggaggattgagtttttctatgagcaatctccagattcaatgagaagcttgtgtagtgcttgggctcttctcactactacactaggaaactacttgagctcgttgatcattacccttgtggcgtatttgagcggaaaagattgttggattccttcagacaacattaacaatggacatcttgattacttcttctggcttttggtcagtcttggatctgttaacatacctgtttttgtcttcttctctgtgaaatatactcatatgaaggtttga

SEQ ID NO: 10 - protein, 545 aa, Arabidopsis thaliana
MASIDEERSLLEVEESLIQEEVKLYAEDGSIDIHGNPPLKQTTGNWKACPFIFANECCERLAYYGIAKNLITYFTNELHETNVSAARHVMTWQGTCYITPLIGALIADAYWGRYWTIACFSAIYFTGMVALTLSASVPGLKPAECIGSLCPPATMVQSTVLFSGLYLIALGTGGIKPCVSSFGADQFDKTDPSERVRKASFFNWFYFTINIGAFVSSTVLVWIQENYGWELGFLIPTVFMGLATMSFFFGTPLYRFQKPRGSPITSVCQVLVAAYRKSNLKVPEDSTDEGDANTNPWKLCTVTQVEEVKILLRLVPIWASGIIFSVLHSQIYTLFVQQGRCMKRTIGLFEIPPATLGMFDTASVLISVPIYDRVIVPLVRRFTGLAKGFTELQRMGIGLFVSVLSLTFAAIVETVRLQLARDLDLVESGDIVPLNIFWQIPQYFLMGTAGVFFFVGRIEFFYEQSPDSMRSLCSAWALLTTTLGNYLSSLIITLVAYLSGKDCWIPSDNINNGHLDYFFWLLVSLGSVNIPVFVFFSVKYTHMKV

SEQ ID NO: 11 - protein, 545 aa, Arabidopsis thaliana; identical to SEQ ID NO: 10

SEQ ID NO: 12 - protein, 590 aa, Arabidopsis thaliana
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 13 - protein, 585 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 14 - protein, 585 aa, Arabidopsis thaliana; identical to SEQ ID NO: 13

SEQ ID NO: 15 - protein, 586 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 16 - protein, 568 aa, Arabidopsis thaliana
MFKILTTKIQSFFCLNISGGTEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 17 - protein, 159 aa, Brassica napus
MGSIEEESPLIEEGLISQEPKLYAQDGSVDLHGNPPLKEKTGNWKACPFILGNECCERLAYYGIAGNLITYLTTKLHQGNVSAARNVTTWQGTCYLTPLIGAVLADAYWGRYWTIACFSGIYFIGMSALTLSASVPALKPAECIGGFCPSATPAQYAMF

SEQ ID NO: 18 - protein, 559 aa, Prunus dulcis
  misc_feature (46)..(46): Xaa can be any naturally occurring amino acid
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 19 - protein, 235 aa, Glycine max
MFPIWATGIIFAAVYAQMSTLFVEQGTMMNTCIGSFKLPPASLSIFDVISVVLWVPLYDRIIVPILRKFTGKERGLSMLQRMGIGLFISVLCMLAAAVVEIMRLQLARELDLVDKPVDVPLSVLWQIPQYFFLGAAEVFTFVGQLEFLYDQSPYGMKTLGTALTLLNFSLGNYLSSFILTMVTYFTTLDGKPGWIPDNLNKGHLDYFFLLLAGLSFLNMSLYIVAAKRYKQKKAC

SEQ ID NO: 20 - protein, 213 aa, Glycine max
  misc_feature (205)..(205): Xaa can be any naturally occurring amino acid
  misc_feature (212)..(212): Xaa can be any naturally occurring amino acid
VEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAXRYKQKKXA

SEQ ID NO: 21 - protein, 584 aa, Vicia faba
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 22 - protein, 580 aa, Lycopersicon esculentum
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 23 - protein, 297 aa, Nepenthes alata
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 24 - protein, 584 aa, Oryza sativa
MDSSYQHDKPLLDEENSSQVTLEYTGDGSVCIRGHPALRKHTGNWKGSSLAIVFSFCSYLAFTSIVKNLVSYLTKVLHETNVAAARDVATWSGTSYLAPLVGAFLADSYLGKYCTILIFCTIFIIGLMMLLLSAAVPLISTGPHSWIIWTDPVSSQNIIFFVGLYMVALGYGAQCPCISSFGADQFDDTDENERTKKSSFFNWTYFVANAGSLISGTVIVWVQDHKGWIWGFTISALFVYLGFGTFIFGSSMYDFRNLEEAPLARICQVVVAAIHKRDKDLPCDSSVLYEFLGQSSAIEGSRKLEHTTGLKFFDRAAMVTPSDFESDGLLNTWKICTVTQVEELKILIRMFPVWATMILFAAVLDNMFSTFIEQGMVMEKHIGSFEIPAASFQSIDVIAVLILVPVYERVLVPVFRKFTGRANGITPLQRMGIGLFFSMLSMVSAALVESNRLRIAQDEGLVHRKVAVPMSILWQGPQYFLIGVGEVFSNIGLTEFFYQESPDAMRSLCLAFSLANVSAGSYLSSFIVSLVPVFTAREGSPGWIPDNLNEGHLDRFFWMMAGLCFLNMLAFVFCAMRYKCKKAS

SEQ ID NO: 25 - protein, 156 aa, Triticum aestivum
IYFIGMSVLTLSASVPMLMPPSCEGAICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKW

SEQ ID NO: 26 - protein, 147 aa, Triticum aestivum
MDAAEETRLLLQEDGDQDASLYTGDGSVDIKGRPATRRDTGNWRACVFILGNECCERLAYYGIAKNLVTYLKIKLHQGNLEAARNVTTWQGTCYLSPLIGAILADSYWGKYWTIAVFSSIYFIGLAVLTLSASLPALQPPSCLGTVC

SEQ ID NO: 27 - protein, 151 aa, Triticum aestivum
  misc_feature (114)..(115): Xaa can be any naturally occurring amino acid
  misc_feature (131)..(131): Xaa can be any naturally occurring amino acid
KILVRMFPVWATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIARXXHLVDQNVPVPLSILWXIPQYFLVGASEVFTFIGAPE

SEQ ID NO: 28 - protein, 592 aa, Zea mays
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTWQGTCYLTPLVGGILADSRWGKYWTIAVFSSVYFIGLAILTLSASVPALQPPSCLRTVCPEASLLQYGIFFGGLYMIALGTGGIKPCVSSFGADQFDDTDQAERAKKGSFFNWFYFCINIVSFISGTMIVWIQDNTGWGIGFAIPTIFMALAISFFFSASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPIWATTIIFSAVYAQNSSMFIEQGMVLDKRIGSFNIPPASLSTFDVISVIMWVPLYDRILVPLARKFTGREKGFSELQRMGIGLVLSILAMLSAALVELKRLEIARSEGLIHEKAAVPMSILWQIPQYFLVGAAEVFTCIGQVEFFYDQAPDAMRSLCSALALITVSLGNYISSIILTLVSYITTQGGDPGWIPDNLNEGHLDRFFWLIAGISFVNLIVYMGCAVRYRYKKAS

SEQ ID NO: 29 - protein, 574 aa, Zea mays
MEAAADEERPLIQYLAPEDDEASSRYTSDGTLDINNQRALKKSTGNWRACFMILGTEFAECLAFYATAKNLVTYLTAELGESNIDAATNVSTSIGSCYLTPLIGAFLADTYWGRYKTMIVFLLLYIVGMLTLTASAWLPLAMEDDSPNNSGLRRATAYLGLYLVSLGTGGIKPCTAALGADQFDGGDAAERVTKASFFNWYYFCTNIGSLLSGTVLVWVQENIGWGVGFTVQTVFMLFGLAVFVAGRKVYRYKKLGGSPLTRVAQVVVAAVRNCHLVLPDDTSALYHDKLLPTEPNFRIESARQFRFFDKAAIITGEKGAAAPTSPWRLCTVSQVEELKMLLRLLPVWASMVLFFAVSAQTVTTFIEQARVMDNRIGPFIIPPASIATFDVISVMVCVPVYDAVLVPLARRATGNDRGLSQLHRLSIGIALSVVVMVYAALLEGRRLALARANMPAMNIAWQAPMFAVHGAAAVFATVGVLEFFYDQSPDGMKSLGNALALLSMAAGSYFNSLALSTVGVITASGGERGWLPDDLNKGHMDYFFWMMAALGTLNLLHFLHYCNRRYTGNNNTTS

SEQ ID NO: 30 - protein, 381 aa, Zea mays
MAGAERAEAVALEQGLLDPEESNQVVYTGDGSVDFSGNPVVKERTGRWKACPFILGNECCERLAYYGISTNLVTYLTKKLHAGNASAASSVTTWSGTCYLTPLIGAILADAYWGRYWTIATFSTVYFIGMTLLTLSASVPMLMPPSCEGSFCPAASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPVPEDSSLLYELPNGVSTIEGSRQIEHTDELRCLDKAATVTEVDVKTADFNNPWRICTVTQVEELKILVRMFPVWATTIVFSAVYAQMSTMFVETRDGA

SEQ ID NO: 31 - protein, 570 aa, Zea mays
MEEGGEHTSLLVKDDASCHGEETQSLLEANLGPQLKSKCSDWRAPALILGLECLESMAFNGIATNLVVYLRSVLHGGIASSAATVSLWYGTSFFVPILGAAIADTCLGNYKTILISLIMYLFGIVLITVATFMPSTSVLCDVSSCLSSNGTQTMIFFAGLYLTAVGCGGVRSALLPFGANQFNNENSLDIKKRRNFFSLFYICVIFGVITSGTIIVWVQENVSWAIGYGVATTCIGLALIGFLVGTPIFQEDEPCGSPVKSIFQVIVASFRNMSLEVPADSCLLYEVGSNHIQRTKLAHSDDFRFLDKAAVISDPSLVYGGCRSSWSICTVTEVEELKILIRLLPIWVTGIFFGAAISQMHTTFIQQGTVMDTKIGSLSIPPASLYSFEVICVTLWVLAVNKVLVPAIRTYFANGVELTQLQRIGIGRFLMIFAMAMAALLETKRLHIVQEGELLSIVWQLPQYFVIAGAECFGIITQLEFFHGQAPDSMKSILTAFALLTTALGNYLSSAIITLIAGVTRVWHSPGWIPDDLNKGHLDYYYWCLTTLSLVNFVVYLYFASKYKLKKVVC

SEQ ID NO: 32 - protein, 455 aa, Zea mays
MTVLTASALLPLLMGASYSRSAHRLSAYLGLYLAALGTGGIKPCVCALGADQFDASDPVERRAKGSFFNWYYFSINIGSLLSATVVVWVQDNVGWGVGFAIPTLLMLSGLVLFVAGRKVYRYQRVGGSPLTRASQVVVAAVRNYRLVLPEPDDSSAALLHQAPPGTTEGNYSTMQHTSQFRFLDKAAIVAASSGEKGATASPWRLCTVSQVEELKTVLRMFPVWVSMVLFFAATAQMSSTFIEQGETIDNRVGPFTVPPASLSTFDVISVMVCIPIYDKALVPLARRATGKERGLSQLQRLGVGLALSVAGMVYAALLEARRLSLARAAAGGRPPMSIMWQAPAFAVLGAGEVFATIGILEFFYDQSPDGMKSLGTALAQLAVAAGNYFNSAVLAAVAAVTTRNGEAGWIPDDLDKGHLDYFFWFMAVLGVVNLLHFLHCSVRYRGSSNNSTYSS

SEQ ID NO: 33 - protein, 593 aa, Oryza sativa
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 34 - protein, 576 aa, Oryza sativa
MAAIEEERPLLPLQSQDVGSEYTRDGSVDINKEPALKHSTGNWRACFLILGVEFCENMTYFVISRNLVTFLTTVLHESKVDAARNVSAWVGACFLTPVVGAFLADTYWGRYWTIVVFLPVYITGMLIVTVSASLPMFLTSSEHGNVHRSVVYLGLYLAALGSGAMKPCTSSFGADQFDSTDLEELPKKASFFSWSFYMTTVSTLLSSTVLVWLQDNVGWGVGCAIPTVFMIISFPVFIAGSRVYRFRNLGFSPLKSLCQVIVAAVRKCHLQLPENKSLLYEPSNSSSTTEASHKIQPTNQFRFLDKAAIVLPPSDETCIKPMSSWSLCTVTQVEELKMLLRMFPTWASFVIFFAVNGQMSSTFIEQGMAMDNHVGSFAIPPASLTIIAVLSVLVLVPVYEIISVPLVKHFTGQDKGFSHAQRIGIGLSLSMIMMVYAALLEMKRLAIVQSSGLADHNVAAPMSILWQTPAYFLQGVSEIFSCIGMSQFFYDQAPDSMKSVCAALGQLAIASGAYFNTFVLGAVAVITTSSGAPGWIPDNLNEGHLDYFFWMMATLSLLNLAMFVYSSTRHRENTAS

SEQ ID NO: 35 - protein, 578 aa, Oryza sativa
MEAADEERAPLLQPQPQPSRGDADSEYTGDGSVDVNNQPALKRSTGNWRACFMILGVEFSENLAYYGISKNLVTYLTKILHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLSGEKGNVAAAAAPVSRWRQCTVTQVEEVKMLVRMCPIWACLVLFFSVSSQMSSTLVEQGTAMDNRVGPFTIPPASLATFHSIGVLLWIPVYDVALVPLARRATGKPKGITQLQRIGVGLAVAALIMAYSALVEERRLAAARAGAARTSILWQVPAQLMHGMAVVFTSIGKSEFFYDQAPRSMRSMCTALGQLAIAAGNYLSAFLLAVVASATTRGGDPGWIPDDLNKGHLDYFFWLMAALLLLDLLLFVFCAMRYKGSTAAS

SEQ ID NO: 36 - protein, 566 aa, Oryza sativa
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLAKGSFFNWYYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 37 - protein, 601 aa, Oryza sativa
MANEEQRQWMDGEFGCQPVANIFFDFLDLPGEIHHCNFFSFYDLFCSSDEEEGPYTGNGSVDVKGNPASKTHTGKWKACYSILGGEFCGALAYYAVGTNLVSYLTKVQGQSNVTAASNIAAWQGNCYLTTILGAFLADSYWGRHRTIVVSLTTFTFGMVLLTLSAVVPPNMHRSMATFPQEALSSLGLYMTALGLGGIWPCVPTFGADQFDDTDVSEKAQKELFYNWYYFAVNGGFFVASTVIVWVQDNCGWGLGFGIPTLFSVIGVVGFLASMRFYRYQKPGGSALTRICQVVVAAFRKVHVDVPSDSSLLYEMPGKESAIVGSRKLMHTDGLRFFDRAATITASDEASASRPWKLCTVTQVEELKIFARMLPIFLTGVIFNTAEACFPLFVEQGGAMDNHVAAAFALPPASLTTFTCVCILVLAPTYDRVLMPAVSRLTGVKRGLSELHRIGVGMVFAVLALAAAAAVETARLRSVEADAPAVSILWQAPQYVLVGVAKVFGVVGYIEFAYEQSPDAMRSLCQACSLIMVTPGSYLLSAMLTIISSVTGGGGGHGGWIPENLNEGHLDRFFWLMAALQLINLIAFVCCAATYKRKLPTT

SEQ ID NO: 38 - protein, 591 aa, Oryza sativa
MRGNLREQKVYHMEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVRSDWASAAGQTGGDLMPQESIAGDGSGVNLEIR

SEQ ID NO: 39 - protein, 551 aa, Oryza sativa
MEASDEDRPLIHHLPPQEQCSKYTCDGTVNIDSVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 40 - protein, 569 aa, Oryza sativa
MGMESGDAQLPLLHHQASASNQHYTKPPFNWKAPALILAFEFLESIAYAGISLNLVVYLGTVLHGTTASNAANVDTWNGTTFLTPVLGAFLADTYWGKYKTIAISTVFYLIGLLVITASAVIPSLQPAPCNGSSCPPATGFQYFVFFTALYLISVGTGGVKSALLPFGADQYNDSNLEESKKKQSFFSLFFIAINLGVFISGTVVVWIQQNVAWSLGFGISSICLVVATVAFLAGTPVYKVQLPSGSPLKSVVMVFVASFKKRKLEVPADNALLYEGDDADLSNGQSVKLAHTDGFRWLDKAAVVFEEVEEINKDEGGGGGWLQCSVTQVEEVKILLRMLPIWVTSVLYAASLGQTATTFVQQGNAMNTKIGSFSVPAASLNSAEVIFMMIWVVFQDTVVVPIARRYTGNPAGLTQLQRMGVGRLLAVPALAVAAVLETWRLRSVRDGGNLSIAWQLPQFVILACSDVFCGIAQLEFFYSEAPVSMRSLCSAFSFLALSLGYYVNSLVVSIVAVVTTTSNKGWLPADLNDGHLDYYFWLWTGISAINFVVYAAFAKNYTVKRLAVPHSH

SEQ ID NO: 41 - protein, 556 aa, Oryza sativa
MAAAAAAAAAEDEEKRPLLLRPNGGGGKEEEDKGGGGGWRACVLILGTELSDCLAFAGIARNLVSYLTGVVGESNVAAARDVSAWTGTCFLTPLVGAFIADSFLGRRTTILLFLSIYSMGMITLTVSASFATPHLDASSDGVLRATVFLGLYLVALGVGGIKPCASPLGADQFDDDDAAPAARASFFNWYYFCINVGSLLAATVLVWVQERAGWWLGFAIPAAVMTAALAAFLFCSTLCGLRAFHTPPGSPLTRLCQVVVAAVRNRGVELPGDSSLLHQLPDGDYRIIEHTNQFAFLDKAAVVASPPAVAMASPWMLCTVTQVEEVKMLLRLSTVWPTVVFFFAATAQMSSTFVEQGKAMDTRVGPLDVPPATLSTFEVVSILLCVPAYDAALMPLARRVTGDRRGLSQLQRLGVGLALSALAMAYSALLEASRRRRAATSIVWQAPSYMALGAAEVFTSVGLLEFFYDQAPDTIKSLCTAVSLVAVAAGSYLNSAIVAVVAWATAPEKGGGGGWIPDDLNRGRLDCFFWLMFGLSCVNLLAFVYSSTRYSYRVAN

SEQ ID NO: 42 - protein, 516 aa, Oryza sativa
MNRHEEFTEWHVGTECLGQLAFFGVQYSLVTFLTTQLRQGNAEAARNFSMWQGTCYIAPLAGAIVADSCLGRYRTILAFFSIYIIGMGTMALSGASPAVISRSTQPAVFSLGLYLMAIGAGCIKSCVGPFGADQFDGGDAMERPKKSSYFNWFYFAMYVGALVSGSAVVWLQDNFGWLLGFGVPALCTVLAMASFLLGSAMYRYHQPRGSQVVRACQVVVAAVRKRNVVLPHDGFVLYDGPAEEGRRMAHTDQFSFLDKAAVAVAVPSSAAAQPWRLCTVTQVEELKAIVRMLPVWATGIVYCMVLVQQPLFPVQGRAMRRRLGVAFAVPAASLNSVYAAAMLVLVPLYDAAVVPAARRLTGSERGLTELQRIGAGMALSVAAMAAAATVEGRRLAAAGEVSIAWQVPQYVLLGASAVLAHIGQLEFFYNQAPDSMRSLCSALGHMTCSLGSYLSSVVVTVVSHATARGGSPGWIADDIDDGHLDRFFWLVAGLSSINLVVFICCAKRYKYKDSIN

SEQ ID NO: 43 - protein, 574 aa, Oryza sativa
MDAGDAMESGQRAALLPESHGPKTEDDSLQVPLLKDKKRGGSKAPAIVLGFECLESTAFNGISTNLVVYLETVLHGSNLASASNVTTWYGTSYLTPIFGAIVADTFLGNYNTILISLAVYLLGMMLVTFSAFLPATAALCAAGATCGTGAAAAQTVAFVGLYLVAVGSGGVRSSLLPFGAEQFDDDSAADRERKAAFFSWFYLCVDFGLIVSGVLLVWIQQNVSWGLGFGIATACIAVAFAAFVLATPMYKRRLPTGTPLKSLAQVVVAAFRKVGMKLPADAELLYEVSDKVDSQPKIAHTSEFTFLDKAAVVSESDLEERPEAASSWKLCTVTQVEELKILLRLLPIWATSIIVSAAYSQMSTTFIQQGSAMDMHIFSVPVPAASLSSFQVLCVLTWVILYSKVIVPALRGFSSSGAAGEPSQLQRMGAGRLLMALAMAVAALVETKRLNAAASGEAINIAWQMPQYFFLAGAEVFCYIAQLEFFFGEAPDTMKSTCTSLALLTIALGSYLSSLIYAVVEAFTATAGGHGWISDDLNQGHLDYFFWMLAAMCTLNFVVYSGFAKNYKLKTVLS

SEQ ID NO: 44 - protein, 577 aa, Oryza sativa
MDEAAAGQRASPLLAKNDGSSYGEESQSLLEEQEPQVKTKQSGWRAPSIILGLECLESMAFNGIATNLVVYIRSVLHGGIASSASTSSLWYGTSFFVPILGATIADTYWGNYKTVLISFIMYLLGTVFITVGAFLPSAPALCNTESCSSMNGTQHLVYFSGLYLTAIGCGGVRSALLPLGADQFNNDSSLDIQKRRNFFSLFYICVIFGVITSGTIVVWIQENVSWAIGYGVATACIALALIGFLVGTPIFRRHEPHGSPVRSVFQVIVASFRNLALELPADSSLLYEVRRKNTQKSEPKLAHTDDFRFLDKAAIMSDLSLDQDSCTSPWRICTVTQVEELKILIRLLPIWATGIFFCVGISQMHTTFIQQGTVMNTKIGSLSIPAASLYSFEVICVTFWVFLVNKVIIPVTRACFANGAEMTQLQRIGIGRFLMIFAMAIAAFLEMKRLESVQGGDQPLSIAWQLPQYFVIAGAECFTIITQLEFFHGQAPDSMKSMLTAFALLTTALGNYFSSAIITLIARVTGTWHSPGWIPDDLNKGHLDYYYWCLAAISAVNFVVYIYFASKYKLKKAVIQV

SEQ ID NO: 45 - protein, 593 aa, Oryza sativa
MDAGEIIVAQPSPRLYKSLTFRRIATKERTIPQDEEMKIRSPRFQDESLTAPFILDKKARSKAPTVVLGFECLESTAFNGIATNLVVYLETLLHGSNLASASNVTTWFGTSYLTPVFGAIIADTFWGNYNTILVSLVFYLLGMMLVTFSAFLPTTALCTVVGSSCQQPLLGAQTIAFLGLYLVAFGSGGVRAALLPFGADQFDDDNTADRERKMSFFSWFYICVDFGMIVSGLFIVWIQQNVSWGLGFGIATACIALAFGGFVLATPMYKRRMPTGTPIKSLAQVVVAACRKARLRVPADTTLLYEVHDKINQSKIAHTDQFGFLDKAAVVMESDLEEESNDVAADASWRICTVTQVEELKILLRLLPIWATSIVLSAAYAQLNTTFVQQGAAMNMRIMSFTIPPASMVSFEVLCVLAWVLMYSSVIVPMLNSLSLANGEPSQLQRMGAGRLLMAFAMAVAALVEMMRLDAAGRGESLSIAWQMPQYFALAGAEVFCYIAQLEFFYSEAPESMKSMCTSLALLTVALGSYMSSFIYAVVNAFTAVDGRPGWISDNLNEGHMDYFFWVMAALCTLNFVVYSAFARTYRVKLVVS

SEQ ID NO: 46 - protein, 593 aa, Oryza sativa
MDAGEIIVAQPSPRLYKSLTFRRIATKERTIPQDEEMKIRSPRFQDESLTAPFILDKKARSKAPTVVLGFEFLESTAFNGIATNLVVYLETLLHGSNLASASNVTTWFGTSYHTPVFGAIIADTFWGNYNTILVSLVFYLLGMMLVTFSAFLPTTALCTVVGSSCQQPLLGAQTIAFLGLYLVAFGSGGVRAALLPFGADQFDDDNTADRERKMSFFSWFYICVDFGMIVSGLFIVWIQQNVSWGLGFGIATACIALAFGGFVLATPMYKRRMPTGTPIKSLAQVVVAACRKARLRVPADTTLLHEAHDKINQSKIAHTDQFGFLDKAAVVMESDLEEESNDVAADASWRICTVTQIEELKILLRLLPIWATSIVLSAAYAQLNTTFVQQGAAMNMRIMSFTIPPASMVSFGVLCVLAWVLMYSSVIVPMLNSLSLANGEPSQLQRMGAGRLLMAFAMAVAALVEMMRLDAAGRGESLSIAWQMPQYFALAGAEVFCYIAQLEFFYSEAPESMKSMCTSLALLTVALGSYMSSFIYAVVNAFTAVDGRPGWISDNLNEGHMDYFFWVVAALCTLNFVVYSAFARTYRVKLVVS

SEQ ID NO: 47 - protein, 575 aa, Oryza sativa
MDAGDAMERGQQRLPESWNPKLQDDVSLTVPLIQDKKSGSKAPAVVLGFECLESTAFNGIATNLVVYLETVLHGSSLASASNVTTWFGTSYLTPVFGAIIADTFFGNYNTILVSLVFYLLGMVLVTFSAFLPTTALCAVAGSTSCQQPVFGAQTIAFVGLYLVAFGSGGVRAALLPFGAEQFDDDNAVDRERKMSFFSWFYMCVDFGMIVSGLFIVWIQQNVSWGLGFGIATVCVAIAFGGFVLATPMYKRSMPTGTPLKSLAQVVVAACRKVSLRVPADAALLYEVHDKIDQPKITHTDEFSFLDKAAVIVQSDLEEDSNDASAAAAGSWRLCTVTQVEELKILMRLLPIWATSIVLSAAYAQLNTTFVQQGAAMNMRIMSFTIPAASMVSFEVFCVLAWVLVYGSVIVPLLRSFSPANGEPSQLRRMGAGRLLIAVAMAIAALVEMVRLDAAARGESLSIAWQMPQYFMLAGGEVFCYIAQLEFFYSEAPESMKSICTSLALLTVALGSYMSSFIYAVVNAFTAVDGRPGWISDNLNEGHLDYFFWVMSALCTLNFVVYSAFARNYKVKTVVS

SEQ ID NO: 48 - protein, 571 aa, Oryza sativa
MSMNNMMGSPPSRSRGRDEKKKRWKWKLGPATILGFELLESIAFSGVALNLVVYLATVLHGTLAFNAAHVDTWNGTTFIVPVIGAFLADSYWGKYRTILASLLFYLAGLVLLTVSAAVPSLRPAPCTGVPCSPATGTQFSVFFLALYLTSIGTGGVKSALLPFGAEQYERDDHDTDQEGAPAPEKTKQSFFSWFFGAINLGIFVAGTLVSWVEQNVSWALGFGIATLCLLIASAAFLAATPCYRVRLPTGDTPIKAILRVLVAAFRNRTRTLPPDADGDGLYEVDDDKNKNGGDDEKLAHTEGLRWLDKAAVRVDGGGVWEVCTVSEVERVKVLARIVPIWVTCVLYAASLGQMTTTFIQQGMAMDTRVFGGRFRVPVASLVSVEVVFMLLWVLLHDVVVMPVARRWWRSGGLTQLQRMGVGRVLVVVAMATAALVERRRLRGEKRSMSILWQVPQFVVLAGSDVFSGIAQLEFFYGEAPGSMRSICSAFSFLALSLGFYVNSLVVTIVAAVTKRSDGSGGWLAPDLDTAHLDYYFWLWALISLANLALYLLLAARYKSKKPSPPHSSSHP

SEQ ID NO: 49 - protein, 617 aa, Oryza sativa
MDADHERRRPEQGALRRPLLADDETCGHRTAECRGVFPFIDFCSAEDCEASSSNQSLVSQEDRGQEVAEVQKVESCSNKALIIILSLQFLEITAFYGVYLNLIVYLQDVLHGDSASNVATVSSWVGTAYLMPILGAAVADSCWGKYTTVLAGFSIALVGMVTITASATLPSLRPPSCGQSAYCVPATLSQKLVFFTGIYLCALGIGGAKAVLIAFGPEQLDDDDGGGKNERVRERKASYFSWYYAVANVGMLTAGTMLVWFEDNVSWGFGYGLCASFVAVAVVVLAATAPMYRILPPAGSPLKSVIQVLVAFSHKAKLTLPDDPTELYEDDGVKNSLQHPVHERLEHTNQFRCLDKAAIVSDEDLEDGDRWRLCTVSQVEEVKILLRLIPIWLTSAVYFIANTQAQTTFVQQGTKTDGRIARGAFSVPAASLSSFQMAFVAVFVTLYNRAVMPAARRCLGRAVAFTPLQLMGFGHATAVVAVGVAACTEARRLHAARAGAPAMGIAWLLPQYLVMAASDASLTVGQLEFFYDQSPETMRSASTAFYFLAISLGNLLNSQLVTLVAKVTAVWGNAGWFPLDLDDGHLDYFFLLIVAITAVNFAVYVALAKNYTPKKVR

SEQ ID NO: 50 - DNA, 1857 bp, Arabidopsis thaliana
  misc_feature (1)..(1857): Ceres clone 3086056 and Ceres cDNA ID 13575971
  CDS (56)..(415)
gcctcataacacataaaacacagtggacgtaactcctctgtttcctctgttctctgtcatggctagtttagtctctggtgataaagaagctcaaatctctggcgatccaggcagcaagcgcggtggatggatcactttcccgttcatgctcgctactttgttaggcctttccgtgacttctttcggatgggtaatgaatttgatcgtcttcctaatcgaagagttcaacatcaagagcatcgctgctgctcagatttcaaatgttgccaatggatgtctcagcatgttgcctgttgttgcagccattctagctgattctttctttggaaacattccggtcatcgcggcctcttctttcatttctctgcttggaatcgttctcttgacgcttattgcatctttggactacttgagacctcggccgtgtgaagcagggtcagtcctatgcacaccgccgtcaaaactccacctcgggatcttgtacacagccttagctttagtgaccactggagcaggtgggacacggttcaccatggcatccgcgggtgcaaaccaatatgagaaacctaaagaacaaggaagcttcttcaactggtacttcctcacactatacgctggagctattactggtgcaacagcaattgtatatatacaagacaatgctagctggaaactagggtttggtctctgcgcggctgctaatttgatcagtttcatagtttttgtctctgggaagagatactacaagcatgacaaaccaatgggaagtcccttcacgagtctaatccgcgttgtagtctctgctacagtaaaaaggaaggctgtaatatcatgcaacgaagaagactatcatcactatggtctcgaaaaggaggtcaagacttctgctgcaatgccatccaagagcttcaggttcttgaaccgcgccgctttgatgaccaaagatgatttaaatcagaaagaaggatcagttaacaacatctggaggctatgctctgtacaagaagtagaagatttcaaagccattctccgagtttttcctctatggttatcaatcatcttcgtgagtactcctatggtgatgcaaacaagcttgattgtactccaagctctagtcacggaccgcggacttggtcctaatttcaaagtcccggccggttccctccaagtaataataatcatcactgcatgcattgttatcatcatgaacaactggcttgtctttccaatgtacaagaagctaactcataagttgctgacaccgcttcaaaaagtcggtataggccaggttctcaccattctaagcatggcactctccgcggtggtagaagcaaagaggctgaaaacagttgaaaatggtcatcccatgtcagtgttatggttgtttcctccccttgtgatagtaggtataggcgaagccttccagtttccggccaatattgaattattttatggcgaattccccgagtctctgaggaacaccgcgacttcattgacctcggtggtgattggaatctctttctatttgagcacagctctcattgatcttatccagaggaccacagcgtggttaccaaatgacattaaccacggaagagtggacaatgtttactggcttttagtcattggaggaatcttgaatttcggctacttccttgtgtgttcttgggtctacaaatatagaaacctcaaggataatgatcaagaacaagatccaaaagatggtacaatgtaaagacacaacatgtttctattctagttctctttacattaattctctcctgttagcttttgtgttttcgtatgttttaccacttcacatatggaactacatttagaaaataatactttcaaact

SEQ ID NO: 51 - protein, 120 aa, Arabidopsis thaliana
VMASLVSGDKEAQISGDPGSKRGGWITFPFMLATLLGLSVTSFGWVMNLIVFLIEEFNIKSIAAAQISNVANGCLSMLPVVAAILADSFFGNIPVIAASSFISLLGIVLLTLIASLDYLR

SEQ ID NO: 52 - DNA, 1677 bp, Arabidopsis thaliana
  CDS (1)..(1677): Ceres in planta sequence from 60.1NB42-35S
atggctagtttagtctctggtgataaagaagctcaaatctctggcgatccaggcagcaagcgcggtggatggatcactttcccgttcatgctcgctactttgttaggcctttccgtgacttctttcggatgggtaatgaatttgatcgtcttcctaatcgaagagttcaacatcaagagcatcgctgctgctcagatttcaaatgttgccaatgcatgtctcagcatgttgcctgttgttgcagccattctagctgattctttctttggaaacattccggtcatcgcggcctcttctttcatttctctgcttggaatcgttctcttgacgcttattgcatctttggactacttgagacctcggccgtgtgaagcagggtcagtcctatgcacaccgccgtcaaaactccacctcgggatcttgtacacagccttagctttagtgaccactggagcaggtgggacacggttcaccatggcatccgcgggtgcaaaccaatatgagaaacctaaagaacaaggaagcttcttcaactggtacttcctcacactatacgctggagctattactggtgcaacagcaattgtatatatacaagacaatgctagctggaaactagggtttggtctctgcgcggctgctaatttgatcagtttcatagtttttgtctctgggaagagacgctacaagcatgacaaaccaatgggaagtcccttcacgagtctaatccgcgttgtagtctctgctacagtaaaagggaaggctgtaatttcatgcaacgaagaagactatcatcactatggtctcgaaaaggaggtcaagacttctgctgcaatgccatccaagagcttcaggttcttgaaccgcgccgctttgatgaccaaagatgatttaaatcagaaagaaggatcagttaacaacatctggaggctatgctctgtacaagaagtagaagatttcaaagccattctccgagtttttcctctatggttatcaatcatcttcgtgagtactcctatggtgatgcaaacaagcttgattgtactccaagctctagtcacggaccgcggacttggtcctaatttcaaagtcccggccggttccctccaagtaataataatcatcactgcatgcattgttatcatcatgaacaactggcctgtctttccaatgtacaagaagctaactcataagttgctgacaccgcttcaaaaagtcggtataggccaggttctcaccattctaagcatggcactctccgcggtggtagaagcaaagaggctgaaaacagttgaaaatggtcatcccatgtcagtgttatggttgtttcctccccttgtgatagtaggtataggcgaagccttccagtttccggccaatattgaattattttatggcgaattccccgagtctctgaggaacaccgcgacttcattgacctcggtggtgattggaatctctttctatttgagcacagctctcattgatcttatccagaggaccacagcgtggttaccaaatgacattaaccacggaagagtggacaatgtttactggcttttagtcattggaggaatcttgaatttcggctacttccttgtgtgttcttgggtctacaaatatagaaacctcaaggataatgatcaagaacaagatccaaaagatggtacaatgtaa

SEQ ID NO: 53 - protein, 558 aa, Arabidopsis thaliana
MASLVSGDKEAQISGDPGSKRGGWITFPFMLATLLGLSVTSFGWVMNLIVFLIEEFNIKSIAAAQISNVANACLSMLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRRYKHDKPMGSPFTSLIRVVVSATVKGKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWPVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 54 - protein, 558 aa, Arabidopsis thaliana
MASLVSGDKEAQISGDPGSKRGGWITFPFMLATLLGLSVTSFGWVMNLIVFLIEEFNIKSIAAAQISNVANGCLSMLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRYYKHDKPMGSPFTSLIRVVVSATVKRKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 55 - protein, 548 aa, Arabidopsis thaliana
MANSDSGDKEAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSAPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 56 - protein, 548 aa, Arabidopsis thaliana
MANSDSGDKDAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSVPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 57 - protein, 555 aa, Arabidopsis thaliana
MAGLVLSNDTEAKISGDCKRGGCITFPFMIATLLGISVTSYGWVLNLIVFLIEEYNIKSIAAAQISNIVNGCLSMLPVVTAILADSFFGNIPVISASAFISLLGIFLLTLISSFENLRPRPCETGSILCQSPSKLHLGVLYAALALVTAGTSGTRVALASAGANQYDKPRDKGSFFNWYFLTVNTGAIISATAIVYTQENASWRLGFGLCAAANLISFIVFISGKRFYKHDKPMGSPFTSLIRVLVAAILKIKVVTSSKEEDYHREVEKESKTCIGMPSKSFRFLNRAALKSEKDLNQEDGLCHNPWRLCSVEEVEDFKSVLRVLPLWLAILFVGTSIGVQASMTVLQALVTDRGLDSKFKVPAGSLQVIVLISSCVFLVLNNWTIYPIYQKITHKQLTPLQQVGIGQVFNILSMAISAIVEAKRLKTVENEHPMSVLWLLPPLVIVGIGDAFHYMANVAVFYGEFPESMRNTATSVTSVAFGISFYLSTALINLIQRTTAWLPDDINHGRVDNVYWVLVIGGVLNLGYFFVCSWYFTYRKIQDDNRQDPKDVTN

SEQ ID NO: 58 - protein, 516 aa, Arabidopsis thaliana
MARSVDTEAMTTRDPSSKRGGWKTFPFMIATLLGLSIASFGWVMNLVVFLIKEFNIKSIAATQNSNIVNGCVSMLPVVAAILADSFFGNIPVISVSAFISLLGIILLTMITSLDHLRPPPCETGSILCESPSKLQLGILYIALALVIIGSAGTRFTLASAGANQYEKPKEQGSFFNWYFLTLYTGAITGATAIVYTQENASWKLGFGLCAVANLISFIVFVSGKRYYKHDKPMGSPFTNLIRVVVAATRKRKAVISSREEDYHHGLGREGKTSSAMPSKSFRFFNRAALKTEDDSVNNNWRLCSVQEVEDFKAVFRVLPLLLAIIFVSTPMVTQTSLIILQALVTDRGLGPHFKIPAGSLQVIVIITACIVILMNNCLVYPMYQKLAHKPLTPLQKVGIGHVFIILSMAISAIVEAKRLKTVTNGHSMSVLWLHRDFIASVVIGISFYLSTALITLIQKTTKWLPNDINHGRVDNVYWLLVIVGVLNYFLVCAWFYRYRNLNDDDDQEQDPKDDTT

SEQ ID NO: 59 - protein, 558 aa, Arabidopsis thaliana
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGLSVAANFFSFLVFVSGKRFYKHDKPLGSPFTSLLCVIFAALRKRKAVVSTNEKDYHNESITMPTKSFRFFNRAALKQEDEVKPDGTIRNPWRLCSVQQVEDFKAVIRIIPLALATIFLSTPIAMQLSLTVLQGLVMDRRLGPSFKIPAGSLQVITLLSTCLFIIVNDRVLYPFYQKLTGKHLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWILVIGGVLNLGYFLVCSWLYRYRNLKDDDHKQAANVSH

SEQ ID NO: 60 - protein, 558 aa, Arabidopsis thaliana; identical to SEQ ID NO: 59

SEQ ID NO: 61 - protein, 557 aa, Arabidopsis thaliana
MSGSVSRDAEALKSADSSTRRSGGRITFPFMIVTLFGLTLATLGWLQNLIVYLIEEYNMKSIAAAKILNIFSGFTFMFPAIGAIAADSFFGTIPVILVSSFISLVGVVLLALTTLFDSLRPQACETASKLCQAPTNIQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 62 - protein, 543 aa, Oryza sativa
MAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 63 - DNA, 1551 bp, Arabidopsis thaliana
  CDS (1)..(1551): Ceres cDNA 2997404
atggctcgttcagtcgacacagaagcaatgaccactcgcgatccaagcagcaagcgcggtggctggaaaacgtttccattcatgatcgctacattgttaggactttccatagcttcattcggatgggtgatgaacttggtcgtcttcctaattaaagaattcaacatcaagagcatcgctgctacgcagaattctaatattgttaatggatgtgtgagcatgttgcctgttgttgcagccattctagctgattcttttttcggaaacattcccgtcatctccgtctctgccttcatttctttgcttggcatcattctattgaccatgattacatctttggaccacttgagacctccaccgtgtgaaacagggtcaattctatgcgaatcgccatcaaaactccagctcgggatcttgtatatagccttagctctagtgatcattggatcagctggtacgcggtttaccttagcatccgcgggtgcaaaccaatatgagaaacctaaagaacaaggaagctttttcaactggtacttcctcacactctacactggagctattactggtgcaacagcaattgtatatacacaggaaaatgctagctggaaacttgggttcggtctttgcgccgtcgctaatttgatcagtttcatagttttcgtctctggcaagagatactacaagcatgacaaaccaatgggaagtcccttcacaaatctgatccgcgttgtagtcgctgctacaagaaaaaggaaagctgtgatttcatctagagaagaagactatcaccatgggcttggaagagaaggcaagacatcttctgcaatgccctccaagagctttaggttctttaaccgtgcagcattgaaaaccgaagatgactcagttaataacaactggaggctatgttctgttcaagaagtagaagattttaaagccgttttccgagttctccctctgttactagccatcatcttcgttagtactcccatggtgacgcaaacaagcttgattatattacaagctctagtcacagaccgcggtctcgggcctcacttcaaaatcccggccgggtccctccaagtcatagtaatcatcactgcatgtattgttatcttaatgaacaattgccttgtctatcccatgtaccagaagctagcccataagccattgacaccgcttcaaaaagtcggtataggccacgttttcatcattttaagcatggcgatatccgccattgtggaagcaaagaggctgaaaacagttactaatggccattccatgtcagtgctatggctgcaccgcgacttcattgcctcagtggtgattggaatatctttctacctgagcacagctctgatcactctgatccagaagaccaccaagtggttaccaaatgatattaaccatggaagagttgacaatgtttactggcttttagtcattgtaggagtcttgaactatttccttgtctgcgcttggttttacagatatagaaacctgaatgatgatgatgatcaggaacaagatccaaaagacgatacaacctaa

SEQ ID NO: 64 - protein, 516 aa, Arabidopsis thaliana; identical to SEQ ID NO: 58

SEQ ID NO: 65 - DNA, 1886 bp, Arabidopsis thaliana
  misc_feature (1)..(1886): sequence of in planta Ceres clone 2997404
atggctcgttcagtcgacacagaagcaatgaccactcgcgatccaagcagcaagcgcggtggctggaaaacgtttccattcatgatcggttagtgtattttatgactgtttggtttatgtttttgaacacaaaacatagacaaatgatagtgattgtaaggctctatatggtgcagctacattgttaggactttccatagcttcattcggatgggtgatgaacttggtcgtcttcctaattaaagaattcaacatcaagagcatcgctgctacgcagatttctaatattgttaatggatgtgtgagcatgtttcctgttattgcagccattctagctgattcttttttcggaaacattcccgtcatctccgtctctgccttcatttctttgcttgtaagtctgagacttaaatattctattgtcttgtgtgacacacaaagcttactagttgttaaacgtttccagggcatcgttctattgaccatgattacatctttggactacttgagacctccaccgtgtgaaacggggtcaattctatgccaatcgtcatcaaaactccagctcggaatcttgtatatagccttagctctagtgatcattggatcagctggtacgcggtttaccttagcatccgcgggtgcaaaccaatatgagaaacctaaagaacaaggaagctttttcaactggtacttcctcacactctacactggagctattactggtgcaacagcaattgtatatacacaggaaaatgctagctggaaacttgggttcggtctttgcgccgtcgctaatttgatcagtttcatagttttcgtctctggcaagagatactacaagcatgacaaaccaatgggaagtcccttcacaaatctgatccgcgttgtagtcgctgctacaagaaaaaggaaagctgtgatttcatctagagaagaagactatcaccatgggcttggaagagaaggcaagacatcttctgcaatgccctccaagagctttaggtgaaaaaacaaaaaaaacttgcttcattcatcaaacttaaaacagaacttaaaagagcttttacatgtgcaggttctttaaccgtgcagcattgaaaaccgaagatgactcagttaataacaactggaggctatgttctgttcaagaagtagaagattttaaagccgttttccgagttctccctctgttactagccatcatcttcgttagtactcccatggtgacgcaaacaagcttgattatactaaaagctctagtcacagaccgcggtctcgggcctcacttcaaaatcccggccgggtccctccaagtcatagtaatcatcactgcatgtattgttatcttaatgaacaattgccttgtctatcccatgtaccagaagctagcccataagccattgacaccgcttcaaaaagtcggtataggccacgttttcatcattttaagcatggcgatatccgccattgtggaagcaaagaggctgaaaacagttactaatggccattccatgtcagtgctatggctggttcctccccttgtgatagtaggaataggagaaacgttccaatttccggcgaatattgaattattctatagagaattccccgagtctctgagtagcaccgcgacttcattgacctcagtggtgattggaatatctttctacctgagcacagctctgatcactctgatccagaagaccaccaagtggttaccaaatgatattaaccatggaagagttggcaatgtttactggcttttagtcattgtaggagtcttgaatttcggctatttccttgtctgcgcttggttttacagatatagaaacctgaatgatgatgatgatcaggaacaagatccaaaagacgatacaacctaa

SEQ ID NO: 66 - protein, 516 aa, Arabidopsis thaliana; identical to SEQ ID NO: 58

SEQ ID NO: 67 - DNA, 2106 bp, Arabidopsis thaliana
  misc_feature (1)..(2106): Ceres cDNA ID 13649807
  CDS (40)..(564)
tgcacaaaagaaaccaagagctctcaaacaaaacagccttttacataagaacaaacacccccaaaaactgcaaaaaaaagagagagatcattaatccatcttcaagatgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacagtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattgatcatgaattcatgatcatgatcatgatgatgaacattatgcatgtctatgttgatatgtttgaatttgattttgagttttgtttgtatattttatgatgcttttcttaattacctcttgtttccgagtcgacaaataatggaccgaccgataagggataaaagttaaagttttcccatcaggttctgtataaaagcagaaattgtaacatttcttaagatttgacgc

SEQ ID NO: 68 - protein, 23 aa, Arabidopsis thaliana
EQTPPKTAKKRERSLIHLQDVSS

SEQ ID NO: 69 - protein, 26 aa, Arabidopsis thaliana
CLGLPRPSRRSLKNRRLGQRRHDSLY

SEQ ID NO: 70 - protein, 12 aa, Arabidopsis thaliana
GRGEADDVRYRS

SEQ ID NO: 71 - protein, 17 aa, Arabidopsis thaliana
SGDVFDGNYAFRQCNCG

SEQ ID NO: 72 - protein, 81 aa, Arabidopsis thaliana
HRYQFPRNFFHALSPRWLHRRYLSRQVPNDCYIRRNPSHGCFNLNSINNHTGTSTTKMQSNNVVSLRTSKWNTTDGPILSL

SEQ ID NO: 73 - DNA, 1773 bp, Arabidopsis thaliana
  CDS (1)..(1773): Ceres clone 1816383
atgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacggtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattga

SEQ ID NO: 74 - protein, 590 aa, Arabidopsis thaliana
MSLPETKSDDILLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCNPTTSSHCEQASGIQLTVLYLALYLTALGTGGVKASVSGFGSDQFDETEPKERSKMTYFFNRFFFCINVGSLLAVTVLVYVQDDVGRKWGYGICAFAIVLALSVFLAGTNRYRFKKLIGSPMTQVAAVIVAAWRNRKLELPADPSYLYDVDDIIAAEGSMKGKQKLPHTEQFRSLDKAAIRDQEAGVTSNVFNKWTLSTLTDVEEVKQIVRMLPIWATCILFWTVHAQLTTLSVAQSETLDRSIGSFEIPPASMAVFYVGGLLLTTAVYDRVAIRLCKKLFNYPHGLRPLQRIGLGLFFGSMAMAVAALVELKRLRTAHAHGPTVKTLPLGFYLLIPQYLIVGIGEALIYTGQLDFFLRECPKGMKGMSTGLLLSTLALGFFFSSVLVTIVEKFTGKAHPWIADDLNKGRLYNFYWLVAVLVALNFLIFLVFSKWYVYKEKRLAEVGIELDDEPSIPMGH

SEQ ID NO: 75 - protein, 590 aa, Arabidopsis thaliana; identical to SEQ ID NO: 74

SEQ ID NO: 76 - protein, 589 aa, Brassica napus
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 77 - protein, 588 aa, Brassica napus
MSLPETKSQTLLDAWDFQGRPADRSKTGGWASAAMILCIEAVERLTTLGIGVNLVTYLTGTMHLGNATAANTVTNFLGTSFMLCLLGGFIAHTFLGRYLTIAIFAAIQATGVSILTLSTIIPGFQPPRCPTTSSHCVQPSGIQLTVLYLALYLTALGTGGVKASVSGFGSDQFDETEPKEQSQMTYFFNRFFFCINVGSLLAVTVLVYMQDDVGRKWGYGLCALAIVLSLSIFLAGTNRYRFKKLIGSPMTQVAAVIVAAWWNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 78 - protein, 596 aa, Prunus persica
MSNCTLPETQEKLTLPDAWDFKGRPAERSKTGGWTAAAMILGGEACERLTTLGIAVNLVTYLTGTMHLGNATSANTVTNFLGTSFMLCLLGGFVADTFLGRYLTIAIFATFQAMGVTILTISTTIPSLRPPKCTSDTSTPCIPASGKQLMVLYIALYLTALGTGGLKSSVSGFGSDQFDESDKQERRQMTNFFNWFFFFISIGSLAAVTVLVYIQDNLGRQWGYGICVCAIVLGLIVFLSGTRRYRFKKLVGSPLTQISGVCVAAWRKRNMELPSDMSFLYNVDDIDDGLKKKKKQKLPHSKQFRFLDKAAIKEPKTTSGTAMIINKWSLSTLTDVEEVKLIIRMLPIWATTIMFWTVYAQMTTFSVSQATSMDRHIGKSFQIPPASLTAFFVGSILLTVPVYDRLIVPMARKALENPQGLTPLQRMGVGLVFSIFAMVAAALTEVKRLNIARSHGLTDNPTAEIPLSVFWLVPQFFFVGSGEAFTYIGQLDFFLRECPKGMKTMSTGLFLSTLSLGFFFSSLLVTIVHKTTGHNKPWLADNLNQGKLYDFYWLLALLSALNLVIYLFCANWYVYKDKRLAEEGIELEEPEICAHA

SEQ ID NO: 79 - protein, 347 aa, Glycine max
VCAMLVALLVLLSSTRRYRYKRLVGSPLTQIAMVFVAAWRKRHLELPSDSSLLFNLDDVADESLRKNKQMLPHSKQFRFLDKAAIKDPKMDGEEITMQRNWYLSTLTDVEEVKMVQRILPVWATTIMFWTVYAQMTTFSVQQATTMDRRIGNSFQIPAASLTVFFVGSVLLTVPIYDRVITPIAKKISHNPQGLTPLQRIGVGLVFSIFAMVSAALIEIKRLRMAQFFFVGSGEAFTYIGQLDFFLRECPRGMKTMSTGLFLSTLSLGFFLSSLLVTLVHKATRHREPWLADNLNHGRLHHFYWLLALLSGVNLVAYLFCAKGYVYKDKRLAEAGIELEETDTACHA

SEQ ID NO: 80 - protein, 590 aa, Nicotiana plumbaginifolia
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSTLLYNIDDIPGDGNKKAKQRLPHSKEFRFLDKAAIKVQDTESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFVSSILVTIVHKVTVKNPWLADNLNQGRLYDFYWLLATLSVLNLMVFLFISRRYVYKEKRLAECGIEMEDSEPACH

SEQ ID NO: 81 - protein, 594 aa, Nicotiana tabacum
MALPETQQDSKALPDAWDYKGRPALRSSSGGWASGAMILGVEAVERLTTLGIAVNLVTYLTGTMHLGNATAANNVTNFLGTSFMLTLFGGFVADTFLGRYLTIGIFATVQAMGVTILTISTIIPSLRPPKCEQVGSSSCIPANSKQLMVLYIALYMTALGTGGLKSSVSGFGTDQFDDADKKEKGQMIKFFDWFFFFINVGSLGAVTVLVYIQDNLGREWGYGICACAIVIGLVVFLSGTRKYRFKKLVGSPLTQIASVIVAAWKKRHLELLSDSSLLFEIDDIFGEGNKKNKQKLPHSKEYRFLDKAAIKEDHDLESNGTNVVINKWKLATLTDVEEVKLLIRMLPTWATTIMFWTVYAQMTTFSVSQATTMDRHIGTFEIPPASLTVFFVGSILLTVIFYDRVIVPICRRFMNKPHGLTPLQRIFTGLVLSILAMIAAALTEVKRLKVAHLHGLTNDANATIPLSVFWLVPQFLLVGAGEAFTYIGQLDFFLRECPKGMKTMSTGLFLSTLALGFFFSSILVTIVHVVTGTTNPWLADNLNQGRLYDFYWLLAILSVLNLMFFLYFSRKYVYKEKRLAEMGIELEDDGPVCH

SEQ ID NO: 82 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMELPSDSSLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTSPLQRIAVGLILSIIAMIAAALTEVKRLNVAHLHGLTNDANAKVPLSVFWLVPQFLLVGAGEAFTYIGQLDFFLRECPKGMKTMSTGLFLSTLSLGFFFSSILVTIVHKVTGKNPWLADNLNQGRLYDFYWLLATLSVLNLMIFLFISRRYVYKEKRLAECGIEMEDSEPACH

SEQ ID NO: 83 - protein, 594 aa, Nicotiana tabacum
MALPETQQDSKALPDAWDYKGRPALRSSSGGWASGAMILGVEAVERLTTLGIAVNLVTYLTGTMHLGNASSANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDSDKKEKGQMIKFFDWFFFFINVGSLGAVTVLVYIQDNLGREWGYGICACAIVIALVVFLFGTRKYRFKKLGGSPLTQIASVIVAAWKKRHLELPSDSSLLFEIDDIFGEGNKKSKQKLPHSKEYRFLDKAAIKEDDDLESNGTNVVINKWKLATLTDVEEVKILIRMLPTWATTIMFWTVYAQMTTFSVSQATTMDRHIGTFEIPPATLTVFFVGSILLTVIFYDRIIVPICRRFMNKPHGLTPLQRIFTGLVLSILAMIAAALTEVKRLKVAHLHGLTNDANATIPLTVFWLVPQFLLVGAGEAFTYIGQLDFFLRECPKGMKTMSTGLFLSTLALGFFFSSILVTIVHVVTGTTNPWLADNLNQGRLYDFYWLLAILSVFNLMFFLYSSRKYVYKEKRLAEMGIELEDDGPVCH

SEQ ID NO: 84 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSYLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFFSSILVTIVHKVTVKNPWLADNLNQGRLYDFYWLLATLSVLNLMIFLFISRRYVYKEKRLAECGIEMEDSEPACH

SEQ ID NO: 85 - protein, 160 aa, Triticum aestivum
  misc_feature (135)..(135): Xaa can be any naturally occurring amino acid
MVGLLPQTNAAAQAEVLGDAWDYRGRPAARSTTGRWGAAAMILVAELNERLTTLGIAVNLVTYLTATMHVGNAEAANVVTNFMGTSFMLCLLGGFVADSFLGRYLTIAIFTAIQASGVTILTISTAAPGLRPPAXHGGGRRDRDLLPRVGRQLGVLYLAL

SEQ ID NO: 86 - protein, 146 aa, Triticum aestivum
FLGTSFLLCLLGGFVADTYLGLYLTIAISTAVQAAGMAVLTVSTAAPGLRPAPCKDPTGDGRLPGCAPPTGAQLGVLYLGLYLTALGTGGLKSSVSGFGSDQFDESHAGERRRMARFFGWFFFFISLGSLLAVTVLVYVQDNVGRR

SEQ ID NO: 87 - protein, 160 aa, Triticum aestivum
  misc_feature (158)..(158): Xaa can be any naturally occurring amino acid
CAASIAVGLVVFLAGTRRYRFKKLAGSPLTQIAAVVVAAWRKRGVQLPTDTSMLYDIDVGKVAAIEGASTKKSKLKERIPHTKQFRFLDHAAINSDPAGEPTKWQLATLTDVEEVKTVARMLPIWATTIMFWTVYAQMTTFSVSQATTMDRHIGPSFXIP

SEQ ID NO: 88 - protein, 123 aa, Narcissus pseudonarcissus
QPMSVFWLVPQFFLVGAGEAFCYIGQLDFFLRECPKGMKTMSTGMFLSTLSLGFFLSSALVTIVHKVTGESGQGAWLPDDLNRGKLYDFYWLLAVLSAVNLVAFLVSARWYVYKENRMATDDG

SEQ ID NO: 89 - protein, 603 aa, Oryza sativa
MVGMLPETNAQAAAEEVLGDAWDYRGRPAARSRTGRWGAAAMILVAELNERLTTLGIAVNLVTYLTATMHAGNAEAANVVTNFMGTSFMLCLLGGFVADSFLGRYLTIAIFTAVQASGVTILTISTAAPGLRPAACAAGSAACERATGAQMGVLYLALYLTALGTGGLKSSVSGFGSDQFDESDSGEKSQMMRFFNWFFFFISLGSLLAVTVLVYVQDNLGRPWGYGACAAAIAAGLVVFLAGTRRYRFKKLVGSPLTQIAAVVVAAWRKRRLELPSDPAMLYDIDVGKLAAAEVELAASSKKSKLKQRLPHTKQFRFLDHAAINDAPDGEQSKWTLATLTDVEEVKTVARMLPIWATTIMFWTVYAQMTTFSVSQATTMDRHIGASFQIPAGSLTVFFVGSILLTVPIYDRLVVPVARRATGNPHGLTPLQRIGVGLVLSIVAMVCAALTEVRRLRVARDARVGGGEAVPMTVFWLIPQFLFVGAGEAFTYIGQLDFFLRECPKGMKTMSTGLFLSTLSLGFFVSSALVAAVHKLTGDRHPWLADDLNKGQLHKFYWLLAGVCLANLLVYLVAARWYKYKAGRAAAAGDGGVEMADAEPCLH

SEQ ID NO: 90 - protein, 594 aa, Oryza sativa
MVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWFYFFVSLGALLAVTVLVYVQDNVGRRWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 91 - DNA, 1566 bp, Arabidopsis thaliana
  CDS (1)..(1563)
  misc_feature (1)..(1566): Ceres cDNA ID 2706693
atgtcagttctgtcatgggcttttaccgttgcgtggtttaccctctggatgttgatgctatacttgacgaacgagatgaagctaaagttcacagacgcagctgcgattgtaaatgtgtttgctggtgtatcagctattggtcatcttggcatgcaatttcttgttgatgcatttattggtcacttttggatgctctgtctctctactttagcattcagtttcggtttcgggttcttggcaatatcagcgtcaccaatactttcaggcaatggacaaaagggcctgttctacgtagcgctaacggttatatccgttggtatatttggacggtctatctctttgggagtatttacagaagaccaactagaagacggtaggaacaagggaaaccccgccaagctcgttagctttgtcattggaaatgtggggaattttgtgttcttgttacttgctgctattgcaatgcctcagataagtccgtggtttgttaggttcacgatcccctcgggctgtgaggtattagcaatgctgatttttatttccggtgcgtgttcatacaaacgggttaaaccaggtgggagccctttgacaacggttttccgggtctttatggcttctgcttccaaaatgtcttgtgcatactcgaacaactcaagccagctctatgaaaaagctgagtgtgatcaagatattaagccccacacaagcagcttaaggtatctagatagagctgcaatgatactccaaacagagtctttggaacaacagaggaaaaacagatggaagctttgtcgggtgacagaagtggagcaaacgaaaagcgtcatacgcacggttcctttgtttgcgacatctctcatttcggggattgtcttctctcttggtaatactttcttccttgaacaagcaaaccatatggactccaagttcggatcatggaaccttcctctcccactcctcttactctttagtgaagctgcaaggctaggatcccgagaactatgtgtcatggctgcaaaacgccatgccattgacttccctgaatcacctaaacaaaccaaaacgccttatggtataccagtctccatcatcctatcgatattttgctgctccatcgctgcacatgttgagtctaggaggctcaaagtagttagtactcaaggtttactacatgaaactgtccccatgagtgtattctggctgctcccacagtacattctactcggttcaatcacaggaatctacgaaaacagctttgcgctttacctagaagaaacggtgcctgaagagttgagccaatacatggttctattaaacgtgggagtgtgcggggtcgggatcatgagcaacattgctcttgttagtttggtgggcagtgtaagcggaggcaaatggtttcaagacacaataaacaagagccgggtggataactattattgggttataacagtgttttgcatgttcaatctcttgttatatttcattgtaacctataggtacacagtgtgtaacaagaaagatggtgcaacacaagaaaatgatcgaaggataatcgcttctgtgtag

SEQ ID NO: 92 - protein, 521 aa, Arabidopsis thaliana
MSVLSWAFTVAWFTLWMLMLYLTNEMKLKFTDAAAIVNVFAGVSAIGHLGMQFLVDAFIGHFWMLCLSTLAFSFGFGFLAISASPILSGNGQKGLFYVALTVISVGIFGRSISLGVFTEDQLEDGRNKGNPAKLVSFVIGNVGNFVFLLLAAIAMPQISPWFVRFTIPSGCEVLAMLIFISGACSYKRVKPGGSPLTTVFRVFMASASKMSCAYSNNSSQLYEKAECDQDIKPHTSSLRYLDRAAMILQTESLEQQRKNRWKLCRVTEVEQTKSVIRTVPLFATSLISGIVFSLGNTFFLEQANHMDSKFGSWNLPLPLLLLFSEAARLGSRELCVMAAKRHAIDFPESPKQTKTPYGIPVSIILSIFCCSIAAHVESRRLKVVSTQGLLHETVPMSVFWLLPQYILLGSITGIYENSFALYLEETVPEELSQYMVLLNVGVCGVGIMSNIALVSLVGSVSGGKWFQDTINKSRVDNYYWVITVFCMFNLLLYFIVTYRYTVCNKKDGATQENDRRIIASV

SEQ ID NO: 93 - DNA, 1812 bp, Arabidopsis thaliana
  CDS (1)..(1812): Ceres cDNA ID 12711144
atgaaatatatgtctttttctcaaagtcttgttttgttctttgccatattattacaggaagtggaagaagaggtctcaagatgggaaggctacgccgattggagaaacagagcagccgtgaaaggccgtcacggtggcatgctcgccgcctctttcgtcttagtggtggagatattagagaatctagcgtatttggcgaatgcgagtaatcttgtgctatacctaagagaatacatgcacatgtctccatcaaaatcggcaaatgacgtcaccaatttcatgggcacagcttttctcctagctctcctcggtggtttcctctccgacgctttcttctccacttttcaaatcttcctcatctcagcttccatcgagtttttgggattgatcatactcacaattcaagctcggacaccatccttaatgcctccatcgtgcgatagtcccacatgtgaagaagtgagtggttcgaaggcagcgatgctattcgtggggttgtaccttgtagctttgggtgtgggagggatcaaaggttcattagcatctcacggagcagaacagtttgatgagagtacacctaaaggtcggaaacaaaggtcaacgttctttaactacttcgtgttttgtcttgcttgtggagcactagttgctgtcacgtttgtagtttggttagaagacaacaaaggatgggaatggggattcggtgtttctaccattgctatcttcgtctctattctcatctttctctctggatcaagattttataggaacaagattccatgtggaagtcctctcaccacaatcttgaaggttcttcttgcggcttcggttaagtgctgctcgagtggaagttcaagcaatgcggttgcgagtatgtccgtgagtccctcaaatcattgcgtatcaaaggggaaaaaagaagttgaatcacaaggagaattggaaaagccacgtcaagaagaagctttgcctcctcgggcacaactaactaacagtttgaaagtattaaatggagctgcggatgaaaaacctgtccatagattgttagaatgcacagtccaacaagtggaagatgtgaagattgtcttgaaaatgcttccgatatttgcttgcactatcatgcttaactgttgcttagctcagctctctacattctccgtccaacaagctgcttccatgaacacaaagataggaagcctaaagatacctccagcttccttaccgatcttccccgtcgttttcataatgatcctcgcacctatctacgaccatctcattatcccattcgctagaaaagctaccaagaccgaaacaggagtcactcatctacaaagaatcggagtaggtttagttctttcgatattagcaatggcggttgcagctctagttgagattaaacgaaagggagtggctaaagactccggcttgcttgactcgaaagaaaccttacccgtgactttcctatggatcgcacttcagtatcttttcctagggtcagccgatctattcacactagctggactactagagtatttcttcacggaagcaccttcctcaatgagatctctcgcaacatcgctctcgtgggcttctttggctatggggtattacctaagctcagtgatcgtgtccatagtaaacagcatcacaggaagctcagggaacacaccttggctcagaggaaaaagcataaaccgttacaaactagactacttctattggctaatgtgtgttcttagtgcagctaacttcttgcactacctcttttgggcaatgcgttacaagtatagatcaactggttcaagaagctaa

SEQ ID NO: 94 - protein, 603 aa, Arabidopsis thaliana
MKYMSFSQSLVLFFAILLQEVEEEVSRWEGYADWRNRAAVKGRHGGMLAASFVLVVEILENLAYLANASNLVLYLREYMHMSPSKSANDVTNFMGTAFLLALLGGFLSDAFFSTFQIFLISASIEFLGLIILTIQARTPSLMPPSCDSPTCEEVSGSKAAMLFVGLYLVALGVGGIKGSLASHGAEQFDESTPKGRKQRSTFFNYFVFCLACGALVAVTFVVWLEDNKGWEWGFGVSTIAIFVSILIFLSGSRFYRNKIPCGSPLTTILKVLLAASVKCCSSGSSSNAVASMSVSPSNHCVSKGKKEVESQGELEKPRQEEALPPRAQLTNSLKVLNGAADEKPVHRLLECTVQQVEDVKIVLKMLPIFACTIMLNCCLAQLSTFSVQQAASMNTKIGSLKIPPASLPIFPVVFIMILAPIYDHLIIPFARKATKTETGVTHLQRIGVGLVLSILAMAVAALVEIKRKGVAKDSGLLDSKETLPVTFLWIALQYLFLGSADLFTLAGLLEYFFTEAPSSMRSLATSLSWASLAMGYYLSSVIVSIVNSITGSSGNTPWLRGKSINRYKLDYFYWLMCVLSAANFLHYLFWAMRYKYRSTGSRS

SEQ ID NO: 95 - protein, 567 aa, Arabidopsis thaliana
MEVEMHGDVSKWEGYADWRNKAALRGRHGGMLAASFVLAVEILENLAFLANASNLVLYLKNFMHMSLARSSSEVTTFMATAFLLALLGGFLADAFFSTFVIFLISASIEFLGLILLTIQARRPSLMPPPCKSSAALRCEVVGGSKAAFLFVGLYLVSLGIGGIKGSLPSHGAEQFDEGTPKGRKQRSTFFNYYVFCLSCGALVAVTFVVWIEDNKGWEWGFGVSTISIFLSILVFLLGSRFYKNKIPRGSPLTTIFKVLLAASIVSCSSKTSSNHFTSREVQSEHEEKTPSQSLTNSLTCLNKAIEGKTHHIWLECTVQQVEDVKIVLKMLPIFGCTIMLNCCLAQLSTYSVHQAATMNRKIVNFNVPSASLPVFPVVFMLILAPTYDHLIIPFARKVTKSEIGITHLQRIGVGLVLSIVAMAVAALVELKRKQVAREAGLLDSEETLPITFLWIALQYLFLGSADLFTLAGLLEFFFTEAPSSMRSLATSLSWASLALGYYLSSVMVPIVNRVTKSAGQSPWLGEKLNRNRLDLFYWLMCVLSVVNFLHYLFWAKRYKYISTGSIS

SEQ ID NO: 96 - protein, 589 aa, Arabidopsis thaliana
MSTNYTAINHILHFHSPNSCFLMIMSLEFEQMDEANRLSAWNGYVDWRSRPALRGRHGGMLAASFVLVVEVLENLAFLANASNLVLYLSTKMGFSPSGAANAVTAFMGTAFFLALLGGFLADAFFTTFHIYLVSAAIEFLGLMVLTVQAHEHSTEPWSRVFLFVGLYLVALGVGGIKGSLPPHGAEQFDEETSSGRRQRSFFFNYFIFSLSCGALIAVTVVVWLEDNKGWSYGFGVSTAAILISVPVFLAGSRVYRLKVPSGSPITTLFKVLTAALYAKYKKRRTSRIVVTCHTRNDCDDSVTKQNCDGDDGFLGSFLGEVVRERESLPRPLRCTEEQVKDVKIVIKILPIFMSTIMLNCCLAQLSTFSVQQASTMNTKLGSFTVPPAALPVFPVVFMMILAPTYNHLLLPLARKSTKTETGITHLQRIGTGLVLSIVAMAVAALVETKRKHVVVSCCSNNNSSSYSSSPLPITFLWVAIQYVFLGSADLFTLAGMMEFFFTEAPSTMRSLATSLSWASLAMGYYFSSVLVSAVNFVTGLNHHNPWLLGENLNQYHLERFYWLMCVLSGINFLHYLFWASRYVYRSNQG

SEQ ID NO: 97 - protein, 558 aa, Arabidopsis thaliana
MDEANRLSAWNGYVDWRSRPALRGRHGGMLAASFVLVVEVLENLAFLANASNLVLYLSTKMGFSPSGAANAVTAFMGTAFFLALLGGFLADAFFTTFHIYLVSAAIEFLGLMVLTVQAHEHSTEPWSRVFLFVGLYLVALGVGGIKGSLPPHGAEQFDEETSSGRRQRSFFFNYFIFSLSCGALIAVTVVVWLEDNKGWSYGFGVSTAAILISVPVFLAGSRVYRLKVPSGSPITTLFKVLTAALYAKYKKRRTSRIVVTCHTRNDCDDSVTKQNCDGDDGFLGSFLGEVVRERESLPRPLRCTEEQVKDVKIVIKILPIFMSTIMLNCCLAQLSTFSVQQASTMNTKLGSFTVPPAALPVFPVVFMMILAPTYNHLLLPLARKSTKTETGITHLQRIGTGLVLSIVAMAVAALVETKRKHVVVSCCSNNNSSSYSSSPLPITFLWVAIQYVFLGSADLFTLAGMMEFFFTEAPSTMRSLATSLSWASLAMGYYFSSVLVSAVNFVTGLNHHNPWLLGENLNQYHLERFYWLMCVLSGINFLHYLFWASRYVYRSNQG

SEQ ID NO: 98 - protein, 151 aa, Brassica napus
MIMSLEIQQMDEANRLSVWNGYVDWRNRPALRGYHGGMLAASFVLVVEVLENLAFLANASNLVLYLSTKMGFSPSGAANAVTAFMGTAFFLALLGGFLADAFFTTFHIYLVSAAIEFLGLLVLTVQAHEHSTEPWARVVLYVGLYLVALGV

SEQ ID NO: 99 - protein, 420 aa, Glycine max
MLFAGLYLVALGVGGVKGSLPSHGAEQFDDNTPSGRRQRSTFFNYFVFCLSCGALIAVTFVVWVEDNKGWEWGFGISTIAIFVSIPVFLAGSTTYRSKIPSGSPLTTILKVLVAASLNSCFNSRNSSSAVVNMTSSPSNPHSGSRKQQAGKEASNTTNKEPEALTNTLKFLNKAADQNNNNPIYSSIECTVEQVEDVKIVLKVLPIFACTIMLNCCLAQLSTFSVEQAATMDTKLGSLKVPPASLPIFPVLFIMVLAPIYDHIITPFARRVTKTEMGITHLQRIGIGLVLSIVAMAVAAVVEVKRKRVAMETHTNNNNSLLGHDATKPLPITFLWIAFQYLFLGSADLFTLAGLLEFFFTEAPSSMRSLATSLSWASLAVGYYLSSAIVSIVNSVTGNTSHRPWLSGANLNHYHLERFYW

SEQ ID NO: 100 - protein, 592 aa, Zea mays
MEDVAPGAEPWEGYVDWRNRPATRSRHGGMAAASFVLVVEVLENLAFLANASNLVTYLMGFMHYSPSQSATAVTNFMGTAFLLALLGGFLSDAFFTTYTIYIASAFIELMGLVILTVQARTQSLMPPQCAKPAAPCEPVSGAKKAMLFAGLYLTALGVGGIKGSLPSHGAEQFDEHAARGRKGRSTFFNYFVFCLSCGALVAVTFAVWVEDNKGWQWGFGISTIAILLSIPLFVAGSSRYRNKVPTGSPLTTIAKVLIAAALARRGCAPSSSNGAVIDRAPSPTGSTDMKEYCKPGDMEEITVSGAAIVASSPAEPSRELAFLNRAVQCQPPRHGRLACTVQEVEDVKIVLMVLPIFLSTIMLNCCLAQLSTFSVEQAATMDTRVGSLTVPPASLPVFPVTFIIILAPVYDHVIVPFARRVTGTEMGITHLQRIGTGLVLSIVAMAVAAVVEVKRKNVASHNGMLDSTKPLPITFFWIAFQYLFLGSADLFTLAGLLEFFFSEAPARMRSLATSLSWASLALGYYLSSVLVSIVNSVTGRGDHRPWLQGASLNHYHLERFYWVMCVLSTINYLFFLFLAVRYKYRNAGVIKG

SEQ ID NO: 101 - protein, 525 aa, Zea mays
MHMDVARATTMASNFFAALQMFSIPAAFLADSYIKRFYTVLIFGPIEILGYILLAVQAHVPSLHPPPCVPGQETSTCESVSGSNLSLLLLGLYLIPIGDGAARACLPALGGEQFDRSDPVEQRQESSFFNWYTFSVSTGGFVGLVFIVWVENSKGWDVGFAVCALSVLLGMLIWIAGLPLYRNQLPTSSPITRILQVLVAAFKKRNVALPANPSELKQISQGDAGSLEILHRTDGFRCLDKAAVDTGRTGGWILCSITQVEETKIILRMVPIFLSAVLGYIPVPLILNFTVQQGNTMDTRLGALHISPATLFIIPTLFQMVILVVYDRFIVPFLRRITGYVGGVTHLQRIGIGFLSTVVATGVAAIVEASRKKVVRDSCLVDATAGIPISVFWLTIQFFLLGIVDVTSFVGLLEFFYSEASTGMKSIGSSIFYCILGVSAWLGSLLIQVANRVTRHRDGTGGWLDGTNLNKGKLERFYWLLAVLELVSLLVYVFFASRYVYGNDQRVVADEDNNTAPSDGTINVI

SEQ ID NO: 102 - protein, 614 aa, Oryza sativa
MENEEMSKVTQANGIDSREHKGQSIAVEANSKGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQSYKGWDKGFGAATGVMGLALLVFIAGLPGYRISVVQGSTALLEILQVYVAAIRNRNMKLPENPDELYEISKSKAPPDTDFMAHRDKPFRFLDKAAIVQAPTDEAPSPWRQCRVTQVEHAKTVLAMVPIFCSAIIMSTCLAQLQTFSIQQGVTMDRTIGTFKMPPASLPIIPLIVLVFAVPIYERGFVPFARRITGHPNGIPHLQRVGVGLVLSIVSMAIAAVVEVRRKRVAARHGMLDANPILGKQLPISCFWLAPQFTVFGVADMFTFIGLLEFFYSQAPPALKSMSSSFLWCPMSLGYFLSTIIVKAVNAATRGATASGGWLAGNNINRNHLDLFFWLLAVLSFLNFLNYLFWASWYKYKPQQSAHVPAEHKV

SEQ ID NO: 103 - protein, 557 aa, Oryza sativa
MVVGGFVDWRGNPIDRKVHGGVRAAWFMFFLSVVTNMENIPNMLNLVTYLHGTMHMGVSSSATTVTNFIGATSGFALLGAFLSDSYITRSRTILLFGPLEFLALGLLALQAYLPSLHPPPCNIEAELSNCEEVHGFNTVILHIGLYTWAFSEGCIRACTPSLGADQFDHEDPSESRQQSSFFNWFTFGISLGGFIGLILIVWLENYKGWDIGFGVCALLILLGLLIVATGLPFYRNQVPEGSPLTRILQVLVVAFKNRKYELPEKLEEAQENRNGLDSIEVPRPTNFLKFLDKASINHGEDGAWSVCSTMKVEETKIVLRMLPLFISSMIGYISNPLLLTFTVQQGSMTNTRLGKIHISPATLFVIPITFQMLMLAVYDRFLVPFMRKRTGYACGITHLQRVGLGFASMIVASAVAAVVERKRKEAAVQMSLFWLAPQFFLLGVSDVTSFVGLLEFFNSEAPKDMKSIGTALFWCELGLASWMGTFLVELVNKATRHGHHRGWLEGTSLNNSHLDLFYWVVAVIGLLGFLNYLYWAKKYAYRHNPRMVTPSADQDSP

SEQ ID NO: 104 - protein, 572 aa, Oryza sativa
MAVGGFLDWRGNPINRKVHGGVRAAWFVYFLTVVTSTVNVPNMLNMVTYLYGTMHMGISSSSTTVTNVLGATSGFALLGAFLSDSYITRARTILLFGPLEFLGYGLLALQAYLPSLRPPPCNAEAEASSCREVHGRNAVLLYAALYISAFGDGFMRACMPPLGADQFDHEDPSESRQQSSFFNWYTFGISFGGFIGLILIVWLENSKGWDVGFGVCAFLILLGLLVVAAGLPLYRNHVPEGSPLTRILQVLVVAFKNRKLQLPEKLEEAQEERSTEQGGSTEVTEIASQTNSSLKFLDKACINGGKDGAWSVCSTKNVEETKAVLRVLPVFISSLIGYMSNPLLFTFTVQQGGLTNTRLGRIHVSPATLFIIPSAFQMALLPVYDRFLVPLLRRRTGYASGVTHLQRVGAGFAAVILASAIAAVVERKRRADAAAAGQMSLFWLAPQFFLLGVSDVTSFPGLLELFSSEAPRGMKSIASALFWCELGLSSWLATLLVQVVNRATRRHGGGGGGGWLEGATLNTSRLDLFYWVVAAVGLLGFVNYLYWASRYIYRQDPRVVVDVEPSADHDSP

SEQ ID NO: 105 - protein, 620 aa, Arabidopsis thaliana
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 106 - protein, 644 aa, Arabidopsis thaliana
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLLLNYFCIVRKRMNLLRDHAIEDDKGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 107 - protein, 600 aa, Oryza sativa
MEIGAVENGGVVGGEVVAGKRGKTPQGWKCMPFIIATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 108 - protein, 591 aa, Oryza sativa
MEIGAVENGGVVGGEVVAGKRGKTPQATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 109 - protein, 572 aa, Glycine max
ENDPKIDYRGWKAMPFIIGNETFEKLGAIGTLANLLVYLTTVFNLKNITATNIINIFNGSTNFATFIGAFLSDTYFGRYKTIGFCTFTSFLGLLVIQLTAVFKNLHPPHCGKEMKTCKGPTAGQMAFLVSGFGLLLIGAAGVRPCNLAFGADQFNPNTDSGKKGINSFFNWYFFTFTFAQMVSLTLIVYVQSNVSWAIGLGIPAALMLISCVVYFMGSKIYVKVEPSGSPIAGIVQVFVVAVKKRSIKLPAEHPMLSLFNYVPPMSVNSKLPYTFQFRLLDKAAIVTPKDKIKPDGSAADPWNLCSIQQVEEAKCVVRVLPIWFAAIVYHLVIVQMHTLLVFQALQSDRRLGSSNFKIPGASFNVFLMLSMTLWLPIYDRIVVPFSLSNTPEKSGGITLLQSDGIGIFISALCMIVAGVVEEHRRSLALTNPIGVQPRKGAISSMSGLWLIPQLSLAGLSESFTAVGQVEFYYKQFPENMRSIAGSLFYCGMAGSSYLSTLLISIVHNTSEKSATGNWLPEDLNKGRLDFFYYMIAALEIMNLGYFLLCSKWYKYKEIGSSDLELNQVPKHI

SEQ ID NO: 110 - protein, 572 aa, Glycine max; identical to SEQ ID NO: 109

SEQ ID NO: 111 - protein, 604 aa, Cucumis sativus
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 112 - protein, 574 aa, Oryza sativa
MALNAFAQPVTNYLIKRYNMKPNAATNVANVFSGTYSFSPVVGAFVADAFCGRFWTLLFGAVAAFVAMVVITLSATIRQLKPPSCSDVARQAGTCAGPSGLHRAVLYIGMALLVVATGGANPTSLPFGADQFDHDDASSGSSSNEADERRRRAEEPAGLKRFYNWYYVVTMMASFMALTFIAYIQDKVSWGLGFGIPTALVAATFAVFLAGTPLYVRVPAEGSIFSSVARVVVASCRKRRLTLPHPRDARQQEAVLYNPPVVVAAGTGTSRVFKLPLTLQLSFLNKAAIVTADADEIRPDGSPARPWSLCSVQQVEEVKCLVKIVPVWISGVMWFISVAELTNYTFLQALTMDLHMGRSFTIPPVSIAAIFNLAIVLFVPVYDLLVARAAQRVTGVEGGITVLQRQGVGVAISGLALVVAAVVERRRRASALDNGGTSPMSVFVLAPQLAVMGVSAAFNMIGQMEFYNTEFPDQMRTLANAAFYCAQGASSYLATAVVNVVNARTRRRGGGQGWVAEDINAGKLDHFYYAMAVFAAINFVYFLVCSYFYRYKGEPEVAAEDSPPATPEAVLLKH

SEQ ID NO: 113 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 114 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 115 - protein, 580 aa, Lycopersicon esculentum; identical to SEQ ID NO: 22

SEQ ID NO: 116 - protein, 579 aa, Hordeum vulgare
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 117 - protein, 584 aa, Vicia faba; identical to SEQ ID NO: 21

SEQ ID NO: 118 - protein, 594 aa, Prunus persica
MSNCTLPETQEKLTLPDAWDFKGRPAERSKTGGWTAAAMILGGEACERLTTLGIAVNLVTYLTGTMHLGNATSANTVTNFLGTSFMLCLLGGFVADTFLGRYLTIAIFATFQAMGVTILTISTTIPSLRPPKCTSDTSTPCIPASGKQLMVLYIALYLTALGTGGLKSSVSGFGSDQFDESDKQERRQMTNFFNWFFFFISIGSLAAVTVLVYIQDNLGRQWGYGICVCAIVLGLIVFLSGTRRYRFKKLVGSPLTQISGVCVAAWRKRNMELPSDMSFLYNVDDIDDGLKKKKKQKLPHSKQFRFLDKAAIKEPKTTSGTAMIINKWSLSTLTDVEEVKLIIRMLPIWATTIMFWTVYAQMTTFSVSQATSMDRHIGKSFQIPPASLTAFFVGSILLTVPVYDRLIVPMARKALENPQGLTPLQRMGVGLVFSIFAMVAAALTEVKRLNIARSHGLTDNPTAEIPLSVFWLVPQFFFVGSGEAFTYIGQLDFFLRECPKGMKTMSTGLFLSTLSLGFFFSSLLVTIVHKTTGHNKPWLADNLNQGKLYDFYWLLALLSALNLVIYLFCANWYVYKDKRLAEEGIELEEPEICA

SEQ ID NO: 119 - protein, 567 aa, Solanum demissum
MESSVRGVDEAAIMKSSTRRKNGGWITFPFIIVSATMAGLSLASGGWTSNLIVYLIDEFNMKSIKTAKVYNVINGCTTLFPIVGGILADSYLGSFSVIWFSSLISALGILLLLFTSAIDVLRPPPCDDGSSLCTSPSTHQYAVLYVALALASLGVAGTRFIIAPMGANQFDKPKHQAIFFNWYIFAFYMSFAISTTVIVYVEDNVSWSWGYGISMAFNILGLAMFLIGKRFYCDVKEQGGSPFVNLARVIVVAIQKWRVPLSEQTQHYYHDPSDTTTTLTITQIPTKSFKFLNCAAFITEGDTKPDGSISNPWRLCTVQQVEDLKSLIKLFPLWASGFLISTQLVIQASLLILQALKMDRHMGPHFEIPAGSMLVFILLFTCIAIFIIDRFLYPFLAKYTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAHYLGNTLIDLVQRLSGWLPDNINKGRTDNVFWLCCILGSANFMYYVVCASLYKYKNVDNKSNIAPSK

SEQ ID NO: 120 - protein, 559 aa, Prunus dulcis; identical to SEQ ID NO: 18
  misc_feature (46)..(46): Xaa can be any naturally occurring amino acid

SEQ ID NO: 121 - protein, 228 aa, Glycine max
RALNKAALIMEGELNPDGTRVNQWRLVSIQQVEEVKCLARIIPIWAAGILSLISMTQQGTFTVSQAMKMNRHLGAKFQIPAGSVSVISLITIALWLPFYDRILVPKLRKMTKHEGGITLLLRIGIGMVFSILSMVVAGYVEKVRRDSANSNPTPLGIAPMSVLWLAPHLILMGLCEAFNIIGQIEFFNRQFPEHMRSIGNSFFSCSFGVSSYVSSIIGQHSSSFYKNT

SEQ ID NO: 122 - protein, 594 aa, Nicotiana plumbaginifolia
MALPETQQDSKALPDAWDYKGRPALRSSSGGWASGAMILGVEAVERLTTLGIAVNLVTYLTGTMHLGNATAANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDGDKKEKGQMIKFFDWFFFFINVGSLGAVTVLVYIQDNLGREWGYGICACAIVIGLVVFLSGTRKYRFKKLVGSPLTQIASVIVAAWKKTHLELPSNSSLLFEIDNIFGEGNKKSKQKLPHSKEYRFLDKAAIKEDNDLESNGTKVVINKWKLATLTDVEEVKLLIRMLPTWATTIMFWTVYAQMTTFSVSKATTMDRHIGTFEIPPASLTVFFVGSILLTVIFYDRIIVPICRRFMNKPHGLTPLHRIFTGLVLSILAMIAAALTEVKRLKVAHLHGLTNDANATIPLTVFWLVPQFLLVGAGEAFTYIGQLDFFLRECPKGMKTMSTGLFLSTLALGFFVSSILVTIVHVVTGTKNPWLADNLNQGRLYDFYWLLAILSVFNLMFFLYSSRKYVYKEKRLAEMGIELEDDGPVCH

SEQ ID NO: 123 - protein, 566 aa, Oryza sativa; identical to SEQ ID NO: 36

SEQ ID NO: 124 - protein, 435 aa, Triticum aestivum
  misc_feature (3)..(3): Xaa can be any naturally occurring amino acid
  misc_feature (21)..(21): Xaa can be any naturally occurring amino acid
  misc_feature (328)..(328): Xaa can be any naturally occurring amino acid
  misc_feature (342)..(342): Xaa can be any naturally occurring amino acid
  misc_feature (398)..(398): Xaa can be any naturally occurring amino acid
  misc_feature (400)..(400): Xaa can be any naturally occurring amino acid
  misc_feature (432)..(432): Xaa can be any naturally occurring amino acid
MSXGAGGIRPCSMAFGADQFXRHPKERRSRILQAYFNAYYASIGVAFTVAVTVIVYVQDNVGWKAGFAVPMGLMMLSAVSFLLGSRLYVKEKGSKQMFAGIGAALVAAIRNYRVQLPAKTEDGVYHHLKDCKLTVPTDRLRFLNKACIISNNGGVDLPGTGAAASERDGNVGGRRLCTVDQVEQLKSAVRILPIWSSTVFLAQAMSQNYAVLQANEMDRRIGVGQFRVPGCSLTMFNMVTMSLWSGSYDRWIAPALRRVTGDPRGLTMKQRVGVGLLLATAAMAVSGAVEGARRRLELAGGGGAGMSAFWLVPQFALMGLAEAFGVIXELEFFYTELPKSMXSFSMALLYMAMGVGNLVNSLIVKVVDDASRRGGRTSWLSSDLNAGHYDYYYWLLAXLXAVNFVYFLWCAWKYGEEGKNVEWEEGEGEREXPMA

SEQ ID NO: 125 - protein, 583 aa, Alnus glutinosa
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 126 - protein, 275 aa, Xerophyta humilis
SLQQVEEVKCLLRIIPIWSTGIIYYIAIVQQQTYVVYEALQSDRHLGNTSFLIPAASYSVFAMLAMTIWIPIYDRIIVPRFRKLTGQEGGITLLQRMGVGLVLAIIGMVVSAIIEIQRRSYAIHRPTIGTAPSGGAISSMSSLWLIPQLVILGLSEAFNAIGQIEFYYKQFPENMRSVAGSLFFLGAATANYLSGALIGVVHRVTGRGAGKNWLAGDLNKGRLDYYYFFIAGLGVLNLVYFMMCAKWYKYKEADSSSNAGEISLVDEIISKEPLV

SEQ ID NO: 127 - protein, 297 aa, Nepenthes alata; identical to SEQ ID NO: 23

SEQ ID NO: 128 - protein, 84 aa, Brassica napus
RVLVPFLRRITGHKSGITLLQRIGTGIVFAILSMIVAGLVERKRRIRSINAGDATGMTPMSVFWLSPQLILMGLCEAFNIIGTD

SEQ ID NO: 129 - protein, 201 aa, Cicer arietinum
AILITLAVNDRIIMPLWKKMKGKPGFTNLQRIAIGLLLSTFGMAAASLCEVKRLSVAKSVKGNQATIPISVFLLIPQFFLVGSGEAFIYTGQLDFFITQSPKGMKTMSTGLFLTTLSLGFFISSFLVSVVKKVTGTRDGQGWLADNINKGRLDLFFALLTILSFINFVAFLVCAFWYKPKKAKPSMQMGAINNGSSVEEKC

SEQ ID NO: 130 - protein, 159 aa, Plantago major
MLQRIGIGLVLSLVSIVYAAIIERKRLATAMEYGLVDMPKAVVPMSALWLAPQYVLSGVADVFTMIGLQEFFYDQIPCDLKSIGLAMYLSILGIGSLLSSFLVSFIQNMTKGHGQDGWFADNLNKAHLDYFYWLLAGLSTVGLSAYIYFARSYVYRRKV

SEQ ID NO: 131 - protein, 138 aa, Glycine max
  misc_feature (92)..(92): Xaa can be any naturally occurring amino acid
  misc_feature (130)..(130): Xaa can be any naturally occurring amino acid
LDQVYASNILNIWSGITNFFPLIGAFISDAYVGRFWTIAFASFSSLLGMVVVTLTAWLPELHPPPCTPQQQALNQCVKASTPHLGALLTGLXLLSVGSAGIRPCSIPFGVDQFDPSTDEGKKGINSFFNXYYTTFTVV

SEQ ID NO: 132 - protein, 112 aa, Fragaria x ananassa
EITGHPAGITQLQRVGIGLVLSAVSMAVAGIVEVKRRNYALAHSPLAPGGISLFWLSFQYAIFGIADMFTLVGLLEFFYREAPAGMKSLSTSFTWLSLSFGYFLSSTLLRTH

SEQ ID NO: 133 - protein, 110 aa, Arabidopsis thaliana
MEAGKTPPTTTTTTEKKTEQVKDNDLPTDSPYMATGTLEDYKLKAYGAEVTKSLLLVLEVAPPMLLLLLATHPPPLPPMRKSVKKKKDYNNERVLWIVGKQTHNCSMFNN

SEQ ID NO: 134 - protein, 111 aa, Arabidopsis thaliana
  misc_feature (62)..(62): Xaa can be any naturally occurring amino acid
MEAGKTPPTTTTTTEKKTEQVKDNDLPTDSPYMATGTLEDYKLKAYGAEGHQEPTPGLGGGXHRCSYSFWRRTRRHYHRCESSVKKKKDYNNERVLWIVGKQTHNCSMFNN

SEQ ID NO: 135 - protein, 83 aa, Arabidopsis thaliana
MEAGKTPPTTTTTTEKKTEQVKDNDLPTDSPYMATGTLEDYKLKAYGAEGHQEPTPGLGGGSTDAPTPSGDAPAATTTDAKAP

SEQ ID NO: 136 - protein, 83 aa, Arabidopsis thaliana; identical to SEQ ID NO: 135

SEQ ID NO: 137 - protein, 83 aa, Arabidopsis thaliana; identical to SEQ ID NO: 135

SEQ ID NO: 138 - protein, 83 aa, Arabidopsis thaliana
MEAGKTPPTTTTTTEKKTEQVKDNDLPTDSPYMATGTLEDYKLKAYGAEGHQEPTPGLGGGSTNAPTPSGDAPAATTTDAKAP

SEQ ID NO: 139 - protein, 83 aa, Arabidopsis thaliana; identical to SEQ ID NO: 135

SEQ ID NO: 140 - protein, 83 aa, Arabidopsis thaliana
MEAGKTPPTTTTTTEKKTEQVKDNDLPTDSPYMATGTLEDHKLKAYGAEGHQEPTPGLGGGSTDAPTPSGDAPAATTTDAKAP

SEQ ID NO: 141 - protein, 83 aa, Arabidopsis thaliana
MEAGKTPPTTTTTTENKTEQVKDNDLPTDSPYMATGTLEDYKLKAYGAEGHQEPTPGLGGGSTDAPTPSGDAPAATTTDAKAP

SEQ ID NO: 142 - protein, 82 aa, Brassica napus
MEAEKIPPATTTTEKKPEQEVKNDDLPTNSPYVDESGSLEDYKMKAYGAQGHQEVKAGLGGGSTDAPTPSGGVTTATAEKAP

SEQ ID NO: 143 - protein, 228 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 144 - protein, 225 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLGKFSFLFVS

SEQ ID NO: 145 - protein, 234 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLGKFSFLFVSISGSFLFFQ

SEQ ID NO: 146 - protein, 247 aa, Glycine max
MATMLTKEHGLNLKETELCLGLPGGGGGGGGGGGGGGGEVETPRATGKRGFSETVDLKLNLHSKEDLNENLKNVSKEKTLLKDPAKPPAKAQVVGWPPVRSYRKNMMAVQKVSTEDVAEKTTSSTANPGAFVKVSMDGAPYLRKVDLTMYKSYKELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 147 - protein, 277 aa, Populus tremula x Populus tremuloides
MATATVLGTERADLNYKATELCLGLPGAVGVKNEVETPNKATGKRGFAETVDLKLNLQAKEGVMDLNENINNIASEDKNHLPSATIKDPAKPPAKAQVVGWPPVRSYRKNVLAQKNASEEGFGAQVEGWPPVRSYRKNVLVQKNASEEGEKASTGGCSAAFVKVCMDGAPYLRKVDLKMYKSYQELSDALAKMFSSLTMGNYGAQGMIDFMNESKLMDLLNSSEYVPSYEDKDGDWMLVGDVPWEMFVDSCKRPRIMKGSEAVGLAPRAMEKCKSRT

SEQ ID NO: 148 - protein, 240 aa, Nicotiana tabacum
MTSVMGAECDKIQLDYEAETELRLGLRSAINGNEGEMTSKNNGKRVFSETVDLKLNLSSKDSTVDNQVDNIKEKKNIAPTDPAKPPAKAQVVGWPPVRSFRKNVLTVQKNSTGNGESSGGGAAFVKVSVDGAPYLRKVDLKMYKSYQQLSDALGKMFSSFTIGNCGTHGFKDFMNESKLIDLLNGSDYVPTYEDKDGDWMLVGDVPWEMFVDSCKRLRIMKGSEAIGLAPRAVEKCKNRS

SEQ ID NO: 149 - protein, 227 aa, Plantago major
MVESCTKMNFEETELRLGLPGGAAAAGEKTTNNNNYGKRGYEQTVDLKLNLSSKDLPNQTDLAENKKNDQPVKPPAKAQVVGWPPVRNFRKNVMAVQKTEKAEESGGSAAFVKVSMDGAPYLRKVDLKMYKTYEELSDALGKMFSSFTMSKCDAQGMMDFMNESKLMDLLNGSDYVPTYEDKDGDWMLVGDVPWEMFVGSCKRLRIMKGTEAIGLAPRAMEKCKSRS

SEQ ID NO: 150 - protein, 246 aa, Glycine max
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 151 - protein, 248 aa, Glycine max
MVFEETELRLGLRLGLPGNGAAPTTEAAAELGVRKRGFSETETDETTSVDLMLNLSPKEASAAATTDGADPRENPKTSPKDKNLPLLDPAKPPAKAQVVGWPPVRSFRKNMFAAQKSSGGEESEKNSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 152 - protein, 164 aa, Arabidopsis thaliana
LKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 153 - protein, 164 aa, Arabidopsis thaliana
LKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSFEYVPSYEDKDGDWMLVGDVPWPMFVESCKRLRIMKGSEAIGLAPRAMEKFKNRS

SEQ ID NO: 154 - protein, 231 aa, Glycine max
MINFEETELRLGLPGGSASDHNESTTVKGSGGKRGFSETASVDLKLNLSSSDDSASDSPSSASTEKTTTAAPLPPSRANDPAKPPAKAQVVGWPPVRSFRKNIVQRNKNEEEAAFVKVSMDGAPYLRKVDIKLYKSYQELSDALAKMFSSFTIEKCGSQGMKDFMNETKLIDLLNGSDYVPTYQDKDGDWMLVGDVPWEMFVESCQRLRIMKGSEAIGLAPRAVEKCKNRS

SEQ ID NO: 155 - protein, 194 aa, Mirabilis jalapa
MMKNDMNKSGGGVIAKDVNDNTKVNGANNNADLAKPPAKAQVVGWPPVRSYRKNMLAVQKSTGAPESESEKPAANGGLVKVSMDGAPYLRKVDLKLYKSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 156 - protein, 229 aa, Populus tremula x Populus tremuloides
MEVEKGTKMRFEETELRLGLPGNGGGGTEGGEFARKRGFSETVDLKLNLSSKEGGIDPNHEKTRREKNLLATDPAKPPAKAQVVGWPPVRSFRKNMLAVQKSSTDQESTNKVPGGNATFVKVSMDGAPYLRKVDLNMYKTYHELSDALGKMFSSFTIGNCGSHGMKDFLNESKLIDLLNGTDYVPSYEDKDGDWMLVGDVPWDMFVESCKRLRIMKGTEATGLGNEYTA

SEQ ID NO: 157 - protein, 243 aa, Glycine max
MGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 158 - protein, 252 aa, Glycine max
MEVGLKKENMGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 159 - protein, 254 aa, Glycine max
  misc_feature (162)..(162): Xaa can be any naturally occurring amino acid
MEVGLNKKENMGFEETELRLGLPGNVGGTGTEEVLIRKRGFSETETETEEDESATTVDLMLNLSSKEAAAAADPTDKHKTLPKEKTLLPADPAKPPAKAQVVGWPPVRSFRKNMLAVQKSVGEENEKNSSSPNASFVKVSMDGAPYLRKVDLKMYKSYRELXDSLGKMFSSFTIGNCESQGMKDFMNESKLNDLLNSSDYVPTYEDKDGDWMLVGDVPWEMFVESCKRLRIMKGKEAIGLGLAPRAMAKSKNRS

SEQ ID NO: 160 - protein, 275 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAGKDAAAANGDKSSAAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 161 - protein, 230 aa, Cucumis sativus
MEKKKMGFEETELRLGLPGNNNIGSSELGEVAARKRGFAETVSSETISKVDLKLNLSSKETVGVGDDDLVADSNPSNKDKAVLTADPAKPPAKAQVVGWPPVRSFRKNNMLAFVKVSMDGAPYLRKVDLKMYKSYKQLSDALAAMFGSFTTIGNCGSQEMKDFMNESKLMDLLSGSDYVPTYEDKDGDWMLVGDVPWEMFVESCKRLRIMKGKEAIGLAPRAMEKCKNRS

SEQ ID NO: 162 - protein, 252 aa, Triticum aestivum
MAADLGFEATELRLGLPGGGEGEARSSSGKRGFAETIDLKLKLEPAGEEAPAEEDRADVAVVAAAAAENQEETATDAGGGKMKRSPSQSSVVTTAALPDPAEKPRAPKAQVVGWPPVRSFRKNILAEKSSPAAAAAFVKVSMDGAPYLRKVDLNMYKTYQDLSKALEKMFSSFTIGNCGTPGMNGMNESKLMDLLNGSEYVPTYEDKDGDWMLVGDVPWEMFVESCKRLRIMKGSEAIGLAPRAMEKCKNRS

SEQ ID NO: 163 - protein, 233 aa, Triticum aestivum
MAGADVDVGTELRLGLPGGGAEAAKAGKRGYEDTIDLKLTLPTGGMQEDSAGKPEPAADKAKRPAEAAAADPEKPPAPKAQAVGWPPVRSYRRNAMTVQSVKIKKEEETEKQQPAAAAAAGANGSNFVKVSMDGAPYLRKVDLKMYNTYKDLSIALQKMFSTFTATGNEGKMVEAVNGSDVVTTYEDKDGDWMLVGDVPWEMFVASCKRLRIMKGSEAIGLAPRAKDKYKNKS

SEQ ID NO: 164 - protein, 233 aa, Triticum aestivum; identical to SEQ ID NO: 163

SEQ ID NO: 165 - protein, 302 aa, Pinus pinaster
MERFANDVDEHSLKETELRLGLPGVCESDTGPGQTRNGKRGFSEVMDSTKASSFNDNKWIFPSVKCQPATSAITETAEACKGSQPGLFSATPSQKIMMQGGCGAPQSWAGDNGLSRSTAPKDELHPKTPRDGPTEKTNGASQSQAATDPAMAPAPKAQVVGWPPIRSFRKNTLAANSKPNDEGSSSNALYVKVSMDGAPYLRKVDLKMYSTYHELSSALEKMFSCFNMGQCGAPGLSESKLIDLLNGSEYVPTYEDKDGDWMLVGDVPWEMFVDSCKRLRITKASEAIGLAPRAMEKSRSKN

SEQ ID NO: 166 - protein, 188 aa, Saccharum hybrid cultivar
SSVVTAAAAIQADPAEKPRAPKAQVVGWPPVRSFRKNIMSVQSDKGAGGSKDADKSSPPPAAAAAVGGAAFVKVSLDGAPYLRKVDLKMYKMYKSYQELSKALEKMFSSTIGSCGSQGMNGMNESKLVDLLNGSEYVPTYEDKEGDWMLVGDVPWEMFVESCKRLRIMKGSEAIGLAPRAMEKCKNRS

SEQ ID NO: 167 - protein, 252 aa, Glycine max
  misc_feature (157)..(157): Xaa can be any naturally occurring amino acid
MAGLGFEETKLRLGLPGGSNEAEEAAAAVRSSGKRGYAETIDLVLKLEPASVAAPPFEDDEEVADGVAEAQPSPAAADGQLKRSPSQCSVVTAAQPDADPEKPRAPKAQAVGWPPVRSFRRNMLAATAERGGAALVKVSMDGAPYLRKVDMGTYKSXQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 168 - protein, 236 aa, Oryza sativa
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 169 - protein, 302 aa, Pinus taeda
MERFANDGDEHSLKETELRLGLPGVCESDTGLGQTRNGKRAFSEVMDSTKASSFNDNKWIFPSVKCQPPTSAITETAEACKGSQPGLFSATPGQKIMMQGGCGAPQSWAGDNGLSKSTAPKDELHPKTPRGGPTEKTNAASQSQAATDPAMAPAPKAQVVGWPPIRSFRKNTLAANSKPNDEGSSSNALYVKVSMDGAPYLRKVDLKMYSTYHELSSALEKMFSCFTMGQCGSPGLSESKLIDLLNGSEYVPTYEDKDGDWMLVGDVPWEMFVDSCKRLRITKASEAIGLAPRAMEKSRSKN

SEQ ID NO: 170 - protein, 351 aa, Zinnia elegans
MPPPLLGVEGDGLGNVSLMTSASTMESIFQKNAELTERNYLGLSDCSSFDSTAVSGISEVKRNNLNLKATELRLGLPGSQSPERDVDVDLVNSESLDEKPLFPLLPSKDGICSNSQKVFVSGNKRGFSDAIDEGKWMFGSSGTDSETSNMNGKISSGAQPVMIKDATSKVVTQEQTHATFGTNLNIVNTSNPPAAKAQVVGWPPVRSFRKNILATNSKTNDEVDGKPGPGALFVKVSMDGAPYLRKVDLRSYSTYQQLSSAIEKMFSCFTIGQCGSQGAPGRESLSESKLRDLLHGSEYVLTYEDKDGDWMLVGDVPWDMFIGSCKRLKIMKGSDAIGLAPRAMEKSKNRN

SEQ ID NO: 171 - protein, 359 aa, Vitis vinifera
MSPPLLGVGEEEGQSNVTILASSASMESVCQISSGLKERNYMGLSECSSVDSSAISTDSDGNKSSLNLKATELRLGLPGFLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAPRAVEKCKNRN

SEQ ID NO: 172 - protein, 349 aa, Solanum tuberosum
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDTMDGFSEGKFLSNSGVKSGDAKETSRVQPSKMKDANTQSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 173 - protein, 130 aa, Brassica napus
  misc_feature (122)..(122): Xaa can be any naturally occurring amino acid
MIGQLMNLNATELCLGLPGGTKAVESPAKSSVRNKRGFSETMDLMLNLQCNKEETVDLNNATASKEKTLLKDPAKPPAKAQVVGWPPVRNYRKNMMTQQKTSGEEEASSEKAGNGGGAALVXVSMDGAPY

SEQ ID NO: 174 - protein, 308 aa, Lycopersicon esculentum
MGLSDCSSVDSCNISTSSEDNNGCGLNLKATELRLGLPGSQSPERGEETCPVISTKVDEKLLFPLHPSKDTAFSVSQKTVVSGNKRGFSDAMDGFSEGKFLSNSGVKAGDTKETSRVQPPKMKDANTQSTVPERPSAVNDASNRAGSGAPATKAQVVGWPPIRSFRKNTLASASKNNEEVDGKAGSPALFIKVSMDGAPYLRKVDLRTCSAYQELSSALEKMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 175 - protein, 129 aa, Brassica napus
  misc_feature (42)..(42): Xaa can be any naturally occurring amino acid
MIGQLMNLKATELCLSLPGGAETLDTPAKSAVGNKRGFSETXDLMLNLQSNKERAIDLNNATASKQKTLLKDPVKPPAKAQVVGWPPVRNYRKNIMTNQKTSGADEASSEKAGNGGGGATGATLVKVSM

SEQ ID NO: 176 - protein, 233 aa, Oryza
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 177 - protein, 228 aa, Zea mays
MAGADVDVGTELRLGLPGGGAAAAKKDTIDLKLKLPTAGMEEAAAAARPEPAADKAKRPAEAPAADAEKPPAPKAQAVGWPPVRSYRRNAMTTVVQAVRSKKEEEPEKQQQPAAANAFVKVSMDGAPYLRKVDLKTYSSYKDLSAALKKMFGTFTASGNSMNEGRLVDPAGDADDVVTTYEDKDGDWMLVGDVPWEMFVESCKRLRIMKSSEAIGLAPRTKDKCKNKS

SEQ ID NO: 178 - protein, 252 aa, Pinus taeda
MSCSVGNMAMVLEKSGGNAQHEKRDSLDFAETELKLGLPGVAAGARQRICGKRSFSEAMESRNYTIPDEDITNTSTHEDLDKFKGPIVKEKQMALSANDPPRMGPPPPSKAQVVGWPPVRDFRKVRTVAASNSLYVKVSMDGAPYLRKVDLKLYSTYHELTSALEKMFSCLIIMGKCGSLALNESNLMDLPNGSEYVPTYEDKDGDWMLIGDVPWQMFVDSCQRMRIMTASEAIGLAPRTMENCKNRNRVHP

SEQ ID NO: 179 - protein, 231 aa, Pinus taeda
MSCSVGGMEKSSTGAQQENKCSLDIFAETELRLGLPGVAAGERQRICGKRSFSEAMESRNFSIPQEEAHKFHEPNLGTEKQMVRPANDPPKMGPTPPKAQIVGWPPVKDFRKVRTIAASSSLYVKVSMDGAPYLRKVDLKMYSTYHDLSSALENMFGCLITMGKCGSSGIKESNLMDVVNGSEYVATYEDKDGDWMLVGDVPWQMFVDSCQRVRIMKASEAIGLAPRAMEK

SEQ ID NO: 180 - protein, 106 aa, Glycine max
MDGAPYLRKVDIKLYKSYQELSDALAKMFSSFTIEKCGSQGMKDFMNETNGSDYVPTYEDKDGDWMLVGDVPWEMFVESCKRLRIMKGSEAIGLAPRAVEKCKNRS

SEQ ID NO: 181 - protein, 97 aa, Mirabilis jalapa
KSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 182 - protein, 208 aa, Gossypium hirsutum
MSSENGKRLLETDAGGLNFEATELTLGLPGEPRVTSDGGAKLGSKRGFSETVDLKLGDNNQEVKLGHSLQEAAKSPVSKTQVVGWPPVRGFAKRGKKSCKYVKVAVDGAPYLRKVDLEIYNSYQQLLTSLEDMFSCFTIRNYLNEKKIDQVNGIEYMPTYEDKDGDWMLVGDVPWQMFVESCKRLRLMKSSEAVGLGLKTAPKYSSTN

SEQ ID NO: 183 - protein, 193 aa, Vigna radiata
MENSLGSYEKELNLKATELRLGLPGSDEPEKRATARSNKRSSPEASDEESISNGSDVTKEDNVVPPAKAQVVGWPPIRSYRKNNVQQKKEEESEGNGMYVKVSMAGAPYLRKIDLKVYKSYPELLKALENMFKCIFGEYSEREGYNGSEYAPTYEDKDGDWMLVGDVPWNMFVSSCKRLRIMKGSEAKGLGCF

SEQ ID NO: 184 - protein, 167 aa, Pisum sativum
VVVSKRGFSETESESESESEITTVDLKLNLSPKEGAADPQLKPKEKSLLVSDSGTKPPAKAQVVGWPPVRSFRKNMFAGQKSIGGSEETTKKSSDGSNAISFVKVSMDGAPYLRKIDLKMYKSYPELSDALAKMFNSITNGNCESQGIKDFMKESNKMMDLLNTSDY

SEQ ID NO: 185 - protein, 190 aa, Gossypium barbadense
MEGSVGYDNDLNLRATELRLGLPGTEPVSIVRSNKRSLQQVADDDCGVNGCRSDDQNETAPPPPKAQIVGWPPIRSYRKNNIQTKKNESEGGGIYVKVSMDGAPYLRKIDLKIYSGYPELLQAIENMFKFTIGEYSEREGYKGSDYAPTYEDKDGDWMLVGDVPWEMFITSCKRLRIMKGSEARGLGCGV

SEQ ID NO: 186 - protein, 218 aa, Glycine max
TNPPAKAQVVGWPPVRSYRKNMIAVQKVSNEEVADNTTISTLANSGAFVQVSMDGAPYLRKVDLPMYKSYIRLISCLGQNVQLLHHGYLWGPRNDIFMNDSKLMDLPPSSEYVPPHQNTDGDWMLVGDVPWEMFVVVMQPPGEIMNGSETIGPCVQNIGKMQKQKGKLAQYNVLREIPYATGPMEQIISPTSATLWSGMLLVECVWCLAFCSYKDCVV

SEQ ID NO: 187 - protein, 172 aa, Antirrhinum majus
KATELRLGLPGTDESEPQTSSSIKNNNNKRSSSEMQGSCQKSTQQEESIAPAPKAQVVGWPPVRSFRKNVMKASESDGSGMFVKVSMDGAPYLRKIDLKFYNNYFDLLKALENMFKCTIGVYSEREGYNGSEFAPTYEDKDGDWMLVGDVPWDMFITSCKRLRIMQSKLCCL

SEQ ID NO: 188 - protein, 71 aa, Glycine max
MIDFMNESKLMDLLNSSEYVPSYEDKDGDWMLVGDVPWEMFVESCKRLRIMKGSEAIGLAPRAMEKCKSRS

SEQ ID NO: 189 - protein, 99 aa, Lycopersicon esculentum
  misc_feature (76)..(77): Xaa can be any naturally occurring amino acid
VRSFRKNVMTVQKNTTGAGEISGTGTGAAFVKVSVDGAPYLRKVDLKMYKSYQQLSDALGKMFSSFTIGNCGTQGXXDFMNESKLIDLLNGSDYVPTYE

SEQ ID NO: 190 - protein, 484 aa, Physcomitrella patens
MNVSEGCSTLTGAQLKYSTDKSNMSYETVYRDAAVESPQREVSNESGSTLKEHDYFGLSEVLSSNSSSGKQPEKCCREELNLNESATTLQLGPPAAVKPSGQADGDDAHDEGAGPENPAKRSAYHMQQESLADGRKAAAEMGSFKIQRKNILEEFRAMKAHAHMTKSPKTVQTMQHNMHVSYSGAQMAFGGAKNNGVKRVFSEAVVANHNAASGVGVGVREGNDDVSRCEEMNGTEQLDLKVHLPKGMGMARMAPASGSPSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 191 - protein, 503 aa, Physcomitrella patens
MKFSNEVVHKSMNITEDCSALTGALLKYSTDKSNMNFETLYRDAAVESPQHEVSNESGSTLKEHDYFGLSEVSSSNSSSGKQPEKCCREELNLNESATTLQLGPPAAVKPSGHADGADAHDEGAGPENPAKRPAHHMQQESLADGRKAAAEMGSFKIQRKNILEEFRAMKAQAHMTKSPKPVHTMQHNMHASFSGAQMAFGGAKNNGVKRVFSEAVGGNHIAASGVGVGVREGNDDVSRCEEMNGTEQLDLKVHLPKGMGMARMAPVSGGQNGSAWRNLSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 192 - protein, 102 aa, Lycopersicon esculentum
VRSFRKNMLSQKGNNNNNNNEEISEKDEKTIAFVKVSMDGAPYLRKVDLKMYKSYQQLSHSLTNMFSSFTMGNYGSQGMIDFMNERKLMDVLNSSDYVPTYE

SEQ ID NO: 193 - protein, 183 aa, Avena sativa
YRVSIGLPGNGGWCSGWGRGDDGGAANARASVQGRGETWVRRRSGRQGCGGGGGRREEEGAGPAAKAQVVGWPPIRSYRKNTMATSLSAPRSKDEVEAKQAPVAGCLYVKVSMDGAPYLRKVDLKMYKNYKDLSLELEKKFSCFTVGHGESNGKSGRDGLSDCRLMDPKSGAELVLTYEDKDG

SEQ ID NO: 194 - protein, 174 aa, Zea mays
  misc_feature (152)..(152): Xaa can be any naturally occurring amino acid
MAGADVDVGTELRLGLPGGGADAAKAAKRGFEDTIDLKLKLPTAGMEEAAAAAAAAAKPEPAAEKAKRPAEAPAADAEKPPAPKAQAVGWPPVRSYRRNVMTVQSVKSKKEEEPEKQQSAANAGGNGSAFVKVSMDGAPYLRKVDLKMYNSXHGALRCSEEDVQHLHHIREQHE

SEQ ID NO: 195 - protein, 51 aa, Cucumis sativus
LTCEDKDGDWMLVGDVPWEMFTESCRRLRIMKGSEAIGLAPRATEKCKNRN

SEQ ID NO: 196 - protein, 48 aa, Mirabilis jalapa
EDRDGDWMLVGDVPWEMFVNSCKRLRIMKGSEAIGLAPRAVEKCKSRS

SEQ ID NO: 197 - protein, 52 aa, Mirabilis jalapa
NVLTYEDKDGDWMLVGDVPWEMFIDSCKRLKIMKSSDAIGLAPRTMEKSKSQ

SEQ ID NO: 198 - protein, 86 aa, Glycine max
  misc_feature (85)..(85): Xaa can be any naturally occurring amino acid
MATMLTKEHGLNLKETELCLGLPGGGGGGGGGGEVETPRATGKRGFSETVDLKLNLHSKEDLNENLKNVSKEKTLLKDPAKPPAXA

SEQ ID NO: 199 - protein, 75 aa, Glycine max
MTTMLTNEHGLSLNLKETELCLGLPGGGSEVETPRATGKRGFSETVDLKLNLQTKEDLNENLKNVSKEKTLLKDP

SEQ ID NO: 200 - protein, 111 aa, Citrus limon
METSVPYENDLNLKATELRLGLPGSDENEQQTRNNKRSLPDTPDDLDTKDKSDEAASVAKAQVVGWPPIRSYRKNSLQQKKNEGECAGIYVKVSMDGAPYLRKIDLKLYNG

SEQ ID NO: 201 - protein, 122 aa, Zea mays
  misc_feature (113)..(113): Xaa can be any naturally occurring amino acid
MAGADVDVGTELRLGLPGGGADAAKAAKRGFEDTIDLKLKLPTAGMEEAAAAAAAKPEPAAEKAKRPAEAPAADAEKPPAPKAQAVGWPPVRSYRRNVMTVQSVKSKKEEEPXKQQSAANAG

SEQ ID NO: 202 - protein, 43 aa, Brassica napus
MIGELINLKATELCLGLPGGAEANENLEKSAVGNKRGFSETVD

SEQ ID NO: 203 - protein, 85 aa, Triticum aestivum
  misc_feature (36)..(36): Xaa can be any naturally occurring amino acid
  misc_feature (78)..(78): Xaa can be any naturally occurring amino acid
MDGAPYLRKVDLNMYKTYQDLSKALEKMFSSFTIGXLWNSRDERHERKQADGSAQWIRVCSDVRGQGRRLDARRRRPXGRCSSSH

SEQ ID NO: 204 - protein, 127 aa, Glycine max
FFIMSMCIRISTSFYCANQLVMLFWLIIGTPRVIKIYNMSFEMSFFFQDDNEHTNYSIDKPWKIFETASHIFRVSPHYYVISYINMKFFFFMSTRMFVESCKRLRIMKGKEAIGLAPRAVEKCKNRS

SEQ ID NO: 205 - protein, 164 aa, Parthenium argentatum
MDTTFRLSSGGEDYGGEEELELGLGLGLSSGAYASSSNGAHSQVVGWPPVKTYRMNSLLNQAKFSKNEEEKGVGGNDTSKKKKNIDHENKADEVVAKESEHSGFVKVNMDGLPIGRKVNLNAHDCYETLAVALETMFLKACTSVTSIRRAKQQRSRLLDGSSEF

SEQ ID NO: 206 - protein, 231 aa, Arabidopsis thaliana
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 207 - protein, 229 aa, Glycine max
MPKSKRNRQVTLSKTKKKGRDHKETIVNGIKDAAEKYGHVYVFSFENMRNQKFKEFRDQLKSSSRFFLGSNKVMQVALGRSASDEIRPGLHKVSKLLRGDSGMVFTNLSKEEVERLFKEFEEYDFARTGSNATEKVDLKEGPLEQFTHEMEPFLRKQGMPVRLNKGVVELVSDFVVCEEGKPLSPEASRILRLMGIKMATFRLSLICRWSPDEFELYIDGPDESDIECS

SEQ ID NO: 208 - protein, 234 aa, Triticum aestivum
MPKSKRNRSVTLSKTKKKPGLERKGKVVTEIKDAIERHSSAYVFTYNNMRNQKLKDLRDQLKSSSRIFLAGKKVMQIALGRSPADEAKTGLHKLSKFLQGASGLLFTNLPRDDVERLFREFEVNDFARTGSIATQTVELKEGPLEQFSHEMEPFLRKQGLPVRLNKGVVELVADHVVCEEGKPLSPEAAHTLRVLGTKMATFRLYLVCRWSSDDFEVYKEGLAHLGGEEADESS

SEQ ID NO: 209 - protein, 231 aa, Zea mays
MPKSKCNRPVTLSKTKKKPGLERKGKVVAEIKDAVDKYSSAYVFTYDNMRNQKLKDLREQLKSSSRIFLAGKKVMQIALGRSPADEAKTGLHKLSKFLQGNSGLLFTNLPRDDVERMFREFEEHDFARTGSTAADTVELKEGPLEQFTHEMEPFLRKQGLPVRLNKGVVELVADHVVCEEGKPLSPEAAQTLRLLGIQMATFRLYLVCRWSSDEFEAYKEGLMHLGADDSS

SEQ ID NO: 210 - protein, 139 aa, Brassica napus
MPKSKRDRPVTLSKTKKKGREHKECIVNGIREAVEKYSSVYVFSFENMRNIKFKEFRQQFRHNGRFFLGSNKVMQVALGRSASDEICPGIFKASKLLHGDAGLLVTDMPKEEVESLFNAYEDSDFSRTGSTAVETVELK

SEQ ID NO: 211 - protein, 178 aa, Zea mays
  misc_feature (168)..(168): Xaa can be any naturally occurring amino acid
MPKSKRNRPVTLSKTKKKPGLERKGKVVAEIKDAVDKYSSAYVFTYDNMRNQKLKDLREQLKSSSRIFLAGKKVMQIALGRSPADEAKTGLHKLSKFLQGNSGLLFTNLPRDDVERMFREFEEHDFARTGSTAIDTVELKEGPLEQFTHEMEPFLRKQGLPVRLKQGXCRVGCRPCSL

SEQ ID NO: 212 - protein, 170 aa, Glycine max
MPKSKRNRQVTLSKTKKKGRDHKETIVNGIKDAAEKYGCVYVFSFENMRNQKLKEFREQLKSNSRFFLGSNKVMQVALGRSASDEIRPGLHKVSKLLRGDSGMFFTNLSKEEVERLFKEFEEYDFARTGSIATEKVIGVSSYDYDFFIQHGMVLGPLGGSCKTAIETSNL

SEQ ID NO: 213 - protein, 112 aa, Brassica napus
  misc_feature (22)..(22): Xaa can be any naturally occurring amino acid
  misc_feature (26)..(26): Xaa can be any naturally occurring amino acid
  misc_feature (34)..(34): Xaa can be any naturally occurring amino acid
  misc_feature (65)..(66): Xaa can be any naturally occurring amino acid
  misc_feature (90)..(90): Xaa can be any naturally occurring amino acid
MPKSKRDRPVTLSKTKKKGREXKETXVNGIREAXEKYSSVYVFSFENMRNIKFKEFRQQFRHNGXXFLGSNKVMQVALGRSASDEMHPGXFKVSKMLRGDAGLLVTDMPKEE

SEQ ID NO: 214 - protein, 148 aa, Glycine max
  misc_feature (3)..(4): Xaa can be any naturally occurring amino acid
  misc_feature (12)..(12): Xaa can be any naturally occurring amino acid
  misc_feature (33)..(33): Xaa can be any naturally occurring amino acid
  misc_feature (39)..(39): Xaa can be any naturally occurring amino acid
  misc_feature (44)..(44): Xaa can be any naturally occurring amino acid
  misc_feature (47)..(47): Xaa can be any naturally occurring amino acid
  misc_feature (53)..(53): Xaa can be any naturally occurring amino acid
  misc_feature (58)..(58): Xaa can be any naturally occurring amino acid
  misc_feature (63)..(63): Xaa can be any naturally occurring amino acid
  misc_feature (68)..(69): Xaa can be any naturally occurring amino acid
  misc_feature (79)..(79): Xaa can be any naturally occurring amino acid
  misc_feature (81)..(81): Xaa can be any naturally occurring amino acid
  misc_feature (83)..(83): Xaa can be any naturally occurring amino acid
  misc_feature (88)..(88): Xaa can be any naturally occurring amino acid
  misc_feature (91)..(91): Xaa can be any naturally occurring amino acid
  misc_feature (104)..(104): Xaa can be any naturally occurring amino acid
  misc_feature (109)..(109): Xaa can be any naturally occurring amino acid
  misc_feature (122)..(122): Xaa can be any naturally occurring amino acid
  misc_feature (131)..(131): Xaa can be any naturally occurring amino acid
  misc_feature (142)..(144): Xaa can be any naturally occurring amino acid
  misc_feature (148)..(148): Xaa can be any naturally occurring amino acid
MPXXKRNRQVTXSKTKKKGRDHKETIVNGIKDXAEKYGXVYVFXFEXMRNQKXKEFRXQLKSXSRFFXXSNKVMQVALXRXAXDEIRXGLXKVSKLLRGDSGMXFTNLXKEEVERLFKEFEXYDFARTGSXATEKVDLKEGXXXAIHX

SEQ ID NO: 215 - protein, 101 aa, Brassica napus
  misc_feature (14)..(15): Xaa can be any naturally occurring amino acid
  misc_feature (19)..(19): Xaa can be any naturally occurring amino acid
  misc_feature (31)..(31): Xaa can be any naturally occurring amino acid
  misc_feature (77)..(77): Xaa can be any naturally occurring amino acid
  misc_feature (92)..(92): Xaa can be any naturally occurring amino acid
  misc_feature (99)..(99): Xaa can be any naturally occurring amino acid
MPKSKRDRTVTLSXXKKKXREHKEIIVNGIXEAVEKHTSVYVFSFENMRNIKFKEFRNQFRHTGRFFLGSNKVMQVXLGRSASDEIRPGIFXVSKLLHXDA

SEQ ID NO: 216 - DNA, 2161 bp, Arabidopsis thaliana
  CDS (178)..(1176)
aacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagagatggttttggaggatagaaaggacggttcttctttgccgggacgatccggtagtttctctaaatcgtcaccgtcggagttggatgttgttgatccatacaagcggataagttcgccgggatctatattggatgccgagaaggtggagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggaacgtatatctcagacacttacgttggccgcttcaagaccatcgctttcgcctcattcgccactctcctcggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaggctgaaacttccggcggaagatgacggcactgtacctattacgacacagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaattctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttccaagaaatcgatggaatgatttaatagactatccttagggacaacaagaagattgtcgatgttgtttgaataattactatgacaatgtatgtatcataatatgtaagaactagaatatataataaatttttacctttcatg

SEQ ID NO: 217 - protein, 332 aa, Arabidopsis thaliana
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGTYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRRLKLPAEDDGTVPITTQPSSLACYPSYTAVTNSGVLTKPRWL

SEQ ID NO: 218 - DNA, 1863 bp, Arabidopsis thaliana
  CDS (1)..(1863): Full length cDNA to which Ceres clone 15650 is a truncated version
atggttttggaggatagaaaggacggttcttctttgccgggacgatccggtagtttctctaaatcgtcaccgtcggagttggatgttgttgatccctacaagcggataagttcgccgggatctatattggatgctgagaaggtagagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggagcgtatatctcagacacttatgttggccgcttcaagaccatcgctttcgcctcattcgccactctcctcggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaactctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttcgaagaaatcgatgaaatga

SEQ ID NO: 219 - protein, 620 aa, Arabidopsis thaliana; identical to SEQ ID NO: 105

What is claimed is:

1. A method for increasing nitrogen utilization efficiency in a plant comprising:
    a) transforming a plant cell with an isolated nucleic acid molecule that comprises a nucleotide sequence that encodes an amino acid sequence that is at least 95% identical to the sequence set forth in SEQ ID NO 2;
    b) expressing said nucleic acid molecule in said plant cell; and
    c) generating from said plant cell a transformed plant in which said nucleotide sequence is overexpressed; and
    d) selecting from a plurality of said transformed plants a plant having increased nitrogen use efficiency as compared to a control plant grown under the same conditions.

2. The method of claim 1, wherein said isolated nucleic acid molecule comprises a nucleotide sequence that encodes the amino acid sequence set forth in SEQ ID NO: 2.

* * * * *